US007897725B2

(12) United States Patent
McCarthy et al.

(10) Patent No.: US 7,897,725 B2
(45) Date of Patent: Mar. 1, 2011

(54) DELTA3 (TANGO24) PROTEIN AND NUCLEIC ACID MOLECULES AND USES THEREOF

(75) Inventors: Sean A. McCarthy, San Diego, CA (US); David P. Gearing, Camberwell (AU)

(73) Assignee: Millenium Pharmaceuticals

( * ) Notice: Subject to any disclaimer, the term of this patent is extended or adjusted under 35 U.S.C. 154(b) by 215 days.

(21) Appl. No.: 11/974,478

(22) Filed: Oct. 12, 2007

(65) Prior Publication Data
US 2009/0286956 A1 Nov. 19, 2009

Related U.S. Application Data

(60) Continuation of application No. 11/175,714, filed on Jul. 5, 2005, now abandoned, which is a continuation-in-part of application No. 10/417,719, filed on Apr. 17, 2003, now abandoned, which is a continuation of application No. 09/568,218, filed on May 9, 2000, now abandoned, which is a continuation-in-part of application No. 08/872,855, filed on Jun. 11, 1997, now Pat. No. 6,121,045, which is a continuation-in-part of application No. 08/832,633, filed on Apr. 4, 1997, now abandoned, said application No. 11/175,714 is a continuation-in-part of application No. 10/895,676, filed on Jul. 21, 2004, now abandoned, which is a continuation of application No. 10/105,934, filed on Mar. 25, 2002, now abandoned, which is a continuation of application No. 09/862,972, filed on May 22, 2001, now abandoned, which is a continuation of application No. 09/062,389, filed on Apr. 17, 1998, now abandoned, said application No. 11/175,714 is a continuation-in-part of application No. 10/095,407, filed on Mar. 11, 2002, now abandoned, which is a continuation of application No. 09/451,828, filed on Nov. 30, 1999, now abandoned, which is a division of application No. 09/128,155, filed on Aug. 3, 1998, now Pat. No. 6,117,654, said application No. 11/175,714 is a continuation-in-part of application No. 10/126,560, filed on Apr. 19, 2002, now abandoned, which is a continuation-in-part of application No. 09/237,571, filed on Jan. 26, 1999, now abandoned, which is a continuation-in-part of application No. 09/013,810, filed on Jan. 27, 1998, now Pat. No. 6,197,551, said application No. 11/175,714 is a continuation-in-part of application No. 10/413,899, filed on Apr. 14, 2003, now abandoned, which is a division of application No. 09/940,240, filed on Aug. 27, 2001, now abandoned, which is a continuation of application No. 09/248,239, filed on Feb. 10, 1999, now abandoned, which is a continuation-in-part of application No. 09/023,664, filed on Feb. 10, 1998, now abandoned, said application No. 11/175,714 is a continuation-in-part of application No. 10/105,150, filed on Mar. 25, 2002, now abandoned, which is a continuation of application No. 10/060,680, filed on Jan. 30, 2002, now abandoned, which is a continuation of application No. 09/057,951, filed on Apr. 9, 1998, now abandoned, said application No. 11/175,714 is a continuation-in-part of application No. 10/601,368, filed on Jun. 23, 2003, now abandoned, which is a continuation of application No. 09/572,003, filed on May 15, 2000, now abandoned, which is a continuation-in-part of application No. 09/561,263, filed on Apr. 27, 2000, now abandoned, which is a continuation-in-part of application No. 09/322,790, filed on May 28, 1999, now abandoned.

(60) Provisional application No. 60/062,017, filed on Oct. 10, 1997, provisional application No. 60/044,746, filed on Apr. 18, 1997, provisional application No. 60/091,650, filed on Jul. 2, 1998, provisional application No. 60/091,650, filed on Jul. 2, 1998.

(51) Int. Cl.
C07K 1/00 (2006.01)
C07H 21/04 (2006.01)
C12N 15/85 (2006.01)
C12N 15/63 (2006.01)

(52) U.S. Cl. ............... 530/350; 435/326; 435/320.1; 435/252.3; 435/254.11; 536/23.5

(58) Field of Classification Search .............. None
See application file for complete search history.

(56) References Cited

U.S. PATENT DOCUMENTS

| 5,011,912 | A | 4/1991 | Hopp et al. |
| 6,121,045 | A | 9/2000 | McCarthy et al. |

FOREIGN PATENT DOCUMENTS

| EP | 0325474 | 7/1989 |
| EP | 0861894 | 9/1998 |
| EP | 0972041 | 1/2000 |
| JP | 1240697 | 9/1989 |
| WO | WO-92/19734 | 11/1992 |
| WO | WO-97/01571 | 1/1997 |
| WO | WO-97/19172 | 5/1997 |
| WO | WO-98/45434 | 10/1998 |
| WO | WO-98/51799 | 11/1998 |

OTHER PUBLICATIONS

Artavanis-Tsakonas et al., Notch signaling. Science, 268: 225-32 (1995).
Benedito et al., Loss of notice signaling induced by Dll4 causrs arterial calibre reduction by increasing endothelial cell response to angiogenic stimuli. BMC Dev. Biol., 8: 117-21 (2008).
U.S. Appl. No. 08/832,633, McCarthy et al.
Bettenhausen et al., Genbank Accession No. X80903, Sep. 29, 1995.
Bettenhausen et al., Transient and restricted expression during mouse embryogenesis of Dll1, a murine gene closely related to Drosophila Delta, *Development*, 121: 2407-18 (1995).
Chitnis et al., Primary neurogenesis in Xenopus embryos regulated by a homologue of the Drosophila neurogenic gene Delta, *Nature*, 375: 761-6 (1995).
Clark et al., Genbank Accession No. AAQ89253, dated Oct. 3, 2003.
Disibio et al., Genbank Accession No. U78889, Dec. 3, 1996.
Dornseifer et al., Genbank Accession No. Y11760, Apr. 18, 2005.
Dornseifer et al., Overexpression of zebrafish homolog of the Drosophila neurogenic gene Delta perturbs differentiation of primary neurons and somite development, *Mech. Dev.* 63: 159 (1997).

Dorsch et al. Ectopic expression of Delta4 impairs hematopoietic development and leads to lymphoproliferative disease, *Blood*, 100(6):2046-55 (2002).
Duarte et al., Dosage-sensitive requirement for mouse Dll4 in artery development. Genes Dev. 18: 2474-8 (2004).
Dunwoodie et al., Mouse Dll3: A novel divergent delta gene which may complement the function of other Delta homologues during early pattern formation in the mouse embryo. Development, 124: 3065-76 (1997).
Ellisen et al., TAN-1, the human homolog of the drosophila notch gene, is broken by chromosomal translocations in T lymphoclastic neoplasms. Cell, 66: 649-61 (1991).
Harbe de Angelis et al., Maintenance of somite borders in mice requires the Delta homologue Dll1. Nature, 386: 717-21 (1997).
Harlow et al., Antibodies: A Laboratory Manual (1988).
Henrique et al., Expression of a Delta homologue in prospective neurons in the chick, *Nature*, 375: 787-90 (1995).
Henrique et al., Genbank Accession No. L42229, Jul. 17, 1995.
Henrique et al., Genbank Accession No. GGU26590, Aug. 9, 1995.
Hoey et al., DLL4 blockade inhibits tumor growth and reduces tumor-initiating cell frequency. Cell Stem Cell, 5: 168-77 (2009).
Information regarding commercially available delta (C-20): SC-8155 polyclonal antibody supplied by Santa Cruz Biotechnology, Inc., Jun. 2, 2009.
Ja et al., Notch signaling in development and disease. Clin. Genet. 64: 461-72 (2003).
Jaleco et al., Differential effects of notch ligands delta-1 and jagged-1 in human lymphoid differentiation. J. Exp. Med. 194(7): 991-1001 (2001).
Jen et al., Genbank Accession No. XLU70843, Nov. 30, 1996.
Jen et al., The notice ligand, X-Delta-2, mediates segmentation of the paraxial mesoderm in Xenopus embryos, *Development*, 124: 1169-78 (1997).
Karanu et al., Human homologues of Delta-1 and Delta-4 function as mitogenic regulators of primitive human hematopoietic cells. Blood,97(7): 1960-7 (2001).
McCarthy et al., GenSeq Accession No. AAV68523, Feb. 16, 1999.
McCarthy et al., GenSeq Database Entry No. AAW80813, Feb. 16, 1999.
Milner et al., A human homologue of the drosophila development gene, notch, is expressed in CD34+ hematopoietic precursors. Blood, 83: 2057-62 (1994).
Noguera-Troise et al., Blockade of Dll4 inhibits tumour growth by promoting non-productive angiogenesis. Nature, 444: 1032-7 (2006).
Nye et al., Vertebrate ligands for notch, Dev. Signaling, 5(9): 966-9 (1995).
Rebay et al., Specific EGF repeats of notch mediate interactions with delta and serrate: Implications for notch as a multifunctional receptor. Cell, 67: 697-9 (1991).
Ridgway et al., Inhibition of Dll4 signalling inhibits tumour growth by deregulating angiogenesis. Nature, 444: 1083-7 (2006).
Rubio-Aliaga et al., Dll1 haploinsufficiency in adult mice leads to a complex phenotype affecting metabolic and immunological processes. PLoS One, 4: e6054 (2009).
Sakano et al., GenSeq Accession No. AAW94496, Apr. 22, 1999.
Sakano et al., Genbank Accession No. AAX16297, Apr. 22, 1999.
Sakano et al., Genbank Accession No. BAB16085, dated Oct. 3, 2000.
Shutter et al., Dll4, a novel notch ligand expressed in arterial endothelium, *Gene Dev*. 14: 1313-18 (2000).
Shutter et al., Genbank Access No. AAF76427, dated Jun. 16, 2000.
Singh et al., Expression of notch receptors, notch ligand, and fringe genes in hematopoiesis. Exp. Hematol. 28: 527-34 (2000).
Smith et al., Blocking of HIV-1 infectivity by a soluble, secreted form of CD4 antigen. *Science*, 238: 1704-7 (1987).
Strausberg et al., Genbank Accession No. AAI06951, dated Oct. 4, 2006.
Suzuki et al., Notch signaling in hematopoietic stem cells, *Int. J. Hematol*. 82: 285-94 (2005).
Taga et al., Interleukin-6 triggers the association of its receptor with a possible signal transducer, gq130. *Cell*, 58: 573-81 (1989).
Vassin et al., The neurogenic gene Delta of Drosophila melanogaster is expressed in neurogenic territories and encodes a putative transmembrane protein with EGF-like repeats, *EMBO J*. 6(11): 3431-40 (1987).
Vassin et al., Genbank Accession No. X06289, dated Apr. 18, 2005.
Venter et al., Genbank Accession No. EAW92466, dated Dec. 18, 2006.
Weber et al., Medium-scale ligand-affinity purification of two soluble forms of human interleukin-2 receptor. *J. Chromatogr*. 431: 55-63 (1988).
Yamasaki et al., Cloning and expression of the human interleukin-6 (BSF-2/IFN beta 2) receptor. *Science*, 241: 825-8 (1988).
Yoneya et al., Genbank Accession No. BAB18581, dated Nov. 29, 2000.
Notice of Opposition to European Patent 0972041 filed by Regeneron Pharmaceuticals, Inc., European Patent Office, Jul. 10, 2007.
Notice of Opposition to European Patent 0972041 filed by Anita Thrikettle, European Patent Office, Jul. 11, 2007.
Notice of Opposition to European Patent 1004669 filed by Regeneron Pharmaceuticals, Inc., European Patent Office, Jan. 16, 2008.
Notice of Opposition to European Patent 1004669 filed by Millennium Pharmaceuticals, Inc., European Patent Office, Jan. 17, 2008.
Notice of Opposition to European Patent 1004669 filed by Strawman Limited, European Patent Office, Jan. 17, 2008.
Notice of Opposition to European Patent 1004669 filed by Dr. Albrecht Dehmel, European Patent Office, Feb. 1, 2008.
Yan et al., "Chronic DLL4 blockade induces vascular neoplasms", Nature, 463:E6-E7 (Feb. 2010).

*Primary Examiner* — Olga N Chernyshev

(74) *Attorney, Agent, or Firm* — Marshall, Gerstein & Borun LLP

(57) ABSTRACT

The invention provides novel Delta3, FTHMA-070, Tango85, Tango77, SPOIL, NEOKINE, Tango129 and A259 polypeptides, proteins, and nucleic acid molecules. In addition to isolated, full-length Delta3, FTHMA-070, Tango85, Tango77, SPOIL, NEOKINE, Tango129 and A259 proteins, the invention further provides isolated Delta3, FTHMA-070, Tango85, Tango77, SPOIL, NEOKINE, Tango129 and A259 fusion proteins, antigenic peptides and anti-Delta3, FTHMA-070, Tango85, Tango77, SPOIL, NEOKINE, Tango129 and A259 antibodies. The invention also provides Delta3, FTHMA-070, Tango85, Tango77, SPOIL, NEOKINE, Tango129 and A259 nucleic acid molecules, recombinant expression vectors containing a nucleic acid molecule of the invention, host cells into which the expression vectors have been introduced and non-human transgenic animals in which a Delta3, FTHMA-070, Tango85, Tango77, SPOIL, NEOKINE, Tango129 or A259 gene has been introduced or disrupted. Diagnostic, screening and therapeutic methods utilizing compositions of the invention are also provided.

11 Claims, 12 Drawing Sheets

FIGURE 1

MVLKCIIPPGDSQCAPGVRVTALGHATQRVSSDQQHPQLWECIRKTEAWIIHPHLLNHSLQPGGPCSLSNKCLSSLQRSASA
EKGSPILLGVSKGEFCLYCDKDKGQSHPSLQLKEKLMKLAAQKESARRPFIFYRAQVGSWNMLESAAIIPGWFICTSCNCN
EPVGIXNXVDFDLLGKAQKRGTGSE

FIGURE 2

```
            1                                                           60
IL-1α       MAKVPDLFEDLKNCYSENEDYSSAIDHL--SLNQKSFYDASYGSLHETCTDQFVSLRTSE
IL-1β       MATVPEL-----NC--EMPPFDSDENDLFFEVDGPQKMKGCFQTFDLGCPDESIQLQISQ
Il-1ra      MEI---------------------------------CWG---------------------
muSPOILI    M-----------------------------------------------------------

61                                                          120
IL-1α       TSKMSNFTFKESRVTVSATSSNGKILKKRRLSFSETFTEDDLQSITHDLEETIQPRSAPY
IL-1β       QHINKSFR-QAVSLIVAVEK-----LWQLPVSFPWTFQDEDMSTFFSFIFEEEPILCDSW
Il-1ra      -----PYS-HLISLLLIL------------------------------LFHSEAA-CRP-
muSPOILI    -----------FRILVVV------------------------------CGS-CRT- 121                                                         180
IL-1α       TYQSDLRYKLMKLVRQKFVMNDSLNQTIYQDVDKHY-LSTTWLN--DLQQEVKFDMYAYS
IL-1β       DDDDNLLVCDVPIRQLHYRLRDEQQKSLV--LSDPYELKALHLNGQNINQQVIFSMSFVQ
Il-1ra      -------SGKRPCKMQAFRIWDTNQKTFY--LRNN-QLIAGYLQGPNIKLEEKIDMVPID
muSPOILI    -------ISS---------------------------LQS---------------

181                                                         240
IL-1α       SGGDDSKYPVTLKISDSQLFVS-AQGEDQPVLLKELPETPKLITGSETD--LIFFWKSIN
IL-1β       GEPSNDKIPVALGLKGKNLYLSCVMKDGTPTLQLESVDPKQ-YPKKKMEKRFVFNKIEVK
Il-1ra      LHS------VFLGIHGGKLCLSCAKSGDDIKLQLEEVNITDLSKNKEEDKRFTFIRSEKG
muSPOILI    -------------------------QGKSKQFQEGNIMEMYNKKEPVKASLFYHKKSG 241                                                         287
IL-1α       SKNYFTSAAYPELFIAT--KEQSRVHLARGLPS---MTDFQIS----
IL-1β       SKVEFESAEFPNWYISTSQAEHKPVFLGNNSGQDII--DFTMESVSS
Il-1ra      PTTSFESAACPGWFLCTTLEADRPVSLTNTPEEPLIVTKFYFQ-EDQ
muSPOILI    TTSTFESAAFPGWFIAVCSKGSCPLILTQELGE-IFITDFEMI-VVH
```

FIGURE 3

```
              1                                                            60
muSPOIL-I     M--------------FR------------------------------------------
muSPOIL-II    M--------------NKEKE----------LRAAPPSLRHVQ------------------
huSPOILI      MRGTPGDADGGGRAVYQS---------------------------------------MCK
huSPOIL-II    MRGTPGDADGGGRAVYQSSESNAVGMGLWRLRPSALTLSPVEAPAFSAPLCTLPFPPVCK 61                                                          120
muSPOIL-I     -----------------------------------ILVVVC----------------GSCR
muSPOIL-II    -------DLSSRVWILQNNILTAVPRKEQTVPVTITLLPCQYLDTLETNRGDPTYMGVQR
huSPOILI      PITGTINDLNQQVWTLQGQNLVAVPRSDSVTPVTVAVITCKYPEALEQGRGDPIYLGIQN
huSPOIL-II    PITGTINDLNQQVWTLQGQNLVAVPRSDSVTPVTVAVITCKYPEALEQGRGDPIYLGIQN 121                                                         180
muSPOIL-I     TISSL----QSQGKSKQFQEGNIMEMYNKKEPVKASLFYHKKSGTTSTFESAAFPGWFIA
muSPOIL-II    PMSCLFCTKDGEQPVLQLGEGNIMEMYNKKEPVKASLFYHKKSGTTSTFESAAFPGWFIA
huSPOILI      PEMCLYCEKVGEQPTLQLKEQKIMDLYGQPEPVKPFLFYRAKTGRTSTLESVAFPDWFIA
huSPOIL-II    PEMCLYCEKVGEQPTLQLKEQKIMDLYGQPEPVKPFLFYRAKTGRTSTLESVAFPDWFIA 181              209
muSPOIL-I     VCSKGSCPLILTQELGEIFITDFEMIVVH
muSPOIL-II    VCSKGSCPLILTQELGEIFITDFEMIVVH
huSPOILI      SSKRDQ-PIILTSELGKSYNTAFELNIND
huSPOIL-II    SSKRDQ-PIILTSELGKSYNTAFELNIND
```

FIGURE 4

```
            1                                                          60
IL-1a       MAKVPDLFEDLKNCYSENEDYSSAIDHLSLNQKS--FYDASYGSLHETCTDQFVSLRTSE
IL-1b       MATVPEL-----NC--EMPPFDSDENDLFFEVDGPQKMKGCFQTFDLGCPDESIQLQISQ
Il-1ra      M-----------------------------------------------------------
muSPOIL-I   M-----------------------------------------------------------
muSPOIL-II  M-----------------------------------------------------------
huSPOILI    MRGTPG---------------------DADGGGR---------------------------
huSPOIL-II  MRGTPG---------------------DADGGGR---------------------------

61                                                         120
IL-1a       TSKMSNFTFKESRVTVSAT-----SSNGKILKKRRLS--FSETFTEDDLQSITHDLEETI
IL-1b       QHINKSFRQAVSLIVAVEKLWQLPVSFPWTFQDEDMSTFFSFIFEEEPILCDSWDDDDNL
Il-1ra      EICWGPYSHLISLL-----L--------ILLFHSEAA-------------CR--------
muSPOIL-I   --FR--------------------------------------------------------
muSPOIL-II  --NKEKE-------------LRAA--PPSLRHVQ--------------------------
huSPOILI    AVYQS-------------------------------------------------------
huSPOIL-II  AVYQSSESNAVGMG-----LWRLRPS-ALTLSPVEAPAF-------SAPLCT--------

121                                                        180
IL-1a       QPRSAPYTYQSDLRYKLMKLVRQKFVMNDSLNQTIYQDVDKHYLSTTWLNDLQQEVKFDM
IL-1b       LVCDVPIR---QLHYRLRDEQQKSLVLSDP-----YELKALHLNGQN--INQQVIFSM--
Il-1ra      PSGKRPCK---MQAFRIWDTNQKTFYLRNN------QLIAGYLQGPN--IKLEEKIDMVP
muSPOIL-I   ------------------------------------------------------ILVVV
muSPOIL-II  ------------------DLSSRVWILQNN------ILTA--VPRKE--QTVPVTITLLP
huSPOILI    -----MCK---PITGTINDLNQQVWTLQGQ------NLVA--VPRSD--SVTPVTVAVIT
huSPOIL-II  LPFPPVCK---PITGTINDLNQQVWTLQGQ------NLVA--VPRSD--SVTPVTVAVIT 181                                                        240
IL-1a       YAYSSGGDDSK-YPVTLKISDSQ--LFVSAQGEDQPVLLKELPETPKLITGSETD--LIF
IL-1b       -SFVQGEPSNDKIPVALGLKGKNLYLSCVMKDGTPTLQLES-VDPKQ-YPKKKMEKRFVF
Il-1ra      IDL---------HSVFLGIHGGKLCLSCAKSGDDIKLQLEE-VNITDLSKNKEEDKRFTF
muSPOIL-I   C---------------GSCRTISSL----QSQGKSKQFQE-GNIMEMYNKKEPVKASLF
muSPOIL-II  CQYLDTLETNRGDPTYMGVQRPMSCLFCTKDGEQPVLQLGE-GNIMEMYNKKEPVKASLF
huSPOILI    CKYPEALEQGRGDPIYLGIQNPEMCLYCEKVGEQPTLQLKE-QKIMDLYGQPEPVKPFLF
huSPOIL-II  CKYPEALEQGRGDPIYLGIQNPEMCLYCEKVGEQPTLQLKE-QKIMDLYGQPEPVKPFLF 241                                        293
IL-1a       FWKSINSKNYFTSAAYPELFIAT--KEQSRVHLARGLPS---MTDFQIS----
IL-1b       NKIEVKSKVEFESAEFPNWYISTSQAEHKPVFLGNNSGQ--DIIDFTMESVSS
Il-1ra      IRSEKGPTTSFESAACPGWFLCTTLEADRPVSLTNTPEEPLIVTKFYFQ-EDQ
muSPOIL-I   YHKKSGTTSTFESAAFPGWFIAVCSKGSCPLILTQELGEIFI-TDFEMI-VVH
muSPOIL-II  YHKKSGTTSTFESAAFPGWFIAVCSKGSCPLILTQELGEIFI-TDFEMI-VVH
huSPOILI    YRAKTGRTSTLESVAFPDWFIASSKRDQ-PIILTSELGKSYN-TAFELN-IND
huSPOIL-II  YRAKTGRTSTLESVAFPDWFIASSKRDQ-PIILTSELGKSYN-TAFELN-IND
```

FIGURE 5

```
                 1                                       *  *                            60
huANTIKINE       MRLLAAALLLLLLALYTARVDGSKCKCSRKGPKIRYSDVKKLEMKPKYPHCEEKMVITT
muANTIKINE       MRLLAAALLLLLLALCASRVDGSKCKCSRKGPKIRYSDVKKLEMKPKYPHCEEKMVITT
raANTIKINE       ------------------------RYSDVKKLEMKPKYPHCEEKMVITT
mqANTIKINE       ----AALLLLLALYATRVDGSKCKCSRKGPKIRYSDVKKLEMKPKYPHCEEKMVITT

61            *                        95
huANTIKINE       KSVSRYRGQEHCLHPKLQSTKRFIKWYNAWNEKRRVYEE
muANTIKINE       KSMSRYRGQEHCLHPKLQSTKRFIKWYNAWNEKRRVYEE
raANTIKINE       KSMSRYRGQEHCLHPKLQSTKRFIKWYNAWNEKRRVYEE
mqANTIKINE       KSMSRYRGQEHCLHPKLQSTKRFIKWYNAWNEKRRVYEE
```

```
int_alpha_rpt: domain 1 of 5, from 37 to 90: score 29.5, E = 7.6e-05
               *-pgsyFGysvagvgDlngDksGypDlllvGAPr........GaVYvyf
                 ++FGy+v    +D+     G  + l+vGAP+++++  +++G VY+++
       T259  37  RTAFFGYTVQ-QHDIS----GNKW-LVVGAPLetngyqktGDVYKCP 77 gssnsgggrciplqnls<-*
                 +       g+c+ l    +
       T259  78  VI----HGNCTKLNLGR    90
```

FIGURE 9A

```
>int_alpha_rpt: domain 2 of 5, from 421 to 472: score 19.2, E = 0.097
                *-pgsyFGysvagvgDlngDksGypDlllvGAPr....GaVYvyfgssn
                 +g+y+Gy+v++v+          ++++GAPr +++G+V ++  +
       T259 421  HGAYLGYTVTSVVSS-----RQGRVYVAGAPRfnhtGKVILFTMHN- 461 sgggrciplqnls<-*
                 +++++  q   +
       T259 462  --NRSLTIHQAMR    472
```

FIGURE 9B

```
>int_alpha_rpt: domain 3 of 5, from 476 to 532: score 48.4, E = 1.5e-10
                *-pgsyFGysvagvgDlngDksGypDlllvGAPr........GaVYvyf
                 +gsyFG+ ++   +D++gD   G +D+llvGAP+  +++++G+VYvy
       T259 476  IGSYFGSEIT-SVDIDGD--GVTDVLLVGAPMyfnegrerGKVYVYE 519 gssnsgggrciplqnls<-*
                 +       +r+ +   +l
       T259 520  LR----QNRFVYNGTLK    532
```

FIGURE 9C

```
>int_alpha_rpt: domain 4 of 5, from 538 to 593: score 62.6, E = 8.4e-15
            *-pgsyFGysvagvgDlngDksGypDlllvGAPr.....GaVYvyfgss
                ++++FG+s+a+v+Dln+D  +y+D ++vGAP+++++ Ga+Y+++g +
    T259  538   QNARFGSSIASVRDLNQD--SYND-VVVGAPLednhaGAIYIFHGFR  581 nsgggrciplqnls<-*
            +   +   +p q ++
    T259  582  G--SILKTPKQRIT     593
```

FIGURE 9D

```
>int_alpha_rpt: domain 5 of 5, from 600 to 654: score 16.5, E = 0.57
            *-pgsyFGysvagvgDlngDksGypDlllvGAPr.....GaVYvyfgss
                yFG s+ g  Dln D  G  D l+vGA ++         +v+++++
    T259  600   GLQYFGCSIHGQLDLNED--GLID-LAVGALGnavilWSRPVVQINA  643 nsgggrciplqnls<-*
            +++++p+ + +
    T259  644  ---SLHFEPSKINI     654
```

FIGURE 9E

DELTA3 (TANGO24) PROTEIN AND NUCLEIC ACID MOLECULES AND USES THEREOF

CROSS REFERENCE TO RELATED APPLICATIONS

This application is a continuation of U.S. patent application Ser. No. 11/175,714, filed Jul. 5, 2005, now abandoned.

U.S. patent application Ser. No. 11/175,714, filed Jul. 5, 2005, is a continuation-in-part of U.S. patent application Ser. No. 10/417,719, filed Apr. 17, 2003, now abandoned, which is a continuation of U.S. patent application Ser. No. 09/568,218, filed May 9, 2000, now abandoned, which is a continuation-in-part of U.S. patent application Ser. No. 08/872,855, filed Jun. 11, 1997, now U.S. Pat. No. 6,121,045, which is a continuation-in-part of U.S. patent application Ser. No. 08/832,633, filed Apr. 4, 1997, now abandoned.

U.S. patent application Ser. No. 11/175,714, filed Jul. 5, 2005, is also a continuation-in-part of U.S. patent application Ser. No. 10/895,676, filed Jul. 21, 2004, now abandoned, which is a continuation of U.S. patent application Ser. No. 10/105,934, filed Mar. 25, 2002, now abandoned, which is a continuation of U.S. patent application Ser. No. 09/862,972, filed May 22, 2001, now abandoned, which is a continuation of U.S. patent application Ser. No. 09/062,389, filed Apr. 17, 1998, now abandoned, which claims the benefit of Provisional Application Ser. No. 60/062,017, filed Oct. 10, 1997, now abandoned, and Provisional Application Ser. No. 60/044,746, filed Apr. 18, 1997, now abandoned.

U.S. patent application Ser. No. 11/175,714, filed Jul. 5, 2005, is also a continuation-in-part of U.S. patent application Ser. No. 10/095,407, filed Mar. 11, 2002, now abandoned, which is a continuation of U.S. patent application Ser. No. 09/451,828, filed Nov. 30, 1999, now abandoned, which is a divisional of U.S. patent application Ser. No. 09/128,155, filed Aug. 3, 1998, now U.S. Pat. No. 6,117,654, which claims the benefit of Provisional Application Ser. No. 60/091,650, filed Jul. 2, 1998, now abandoned, and Provisional Application Ser. No. 60/054,646, filed Aug. 4, 1997, now abandoned.

U.S. patent application Ser. No. 11/175,714, filed Jul. 5, 2005, is also a continuation-in-part of U.S. patent application Ser. No. 10/126,560, filed Apr. 19, 2002, now abandoned, which is a continuation-in-part of U.S. patent application Ser. No. 09/237,571, filed Jan. 26, 1999, now abandoned, which is a continuation-in-part of U.S. patent application Ser. No. 09/013,810, filed Jan. 27, 1998, now U.S. Pat. No. 6,197,551.

U.S. patent application Ser. No. 11/175,714, filed Jul. 5, 2005, is also a continuation-in-part of U.S. patent application Ser. No. 10/413,899, filed Apr. 14, 2003, now abandoned, which is a divisional of U.S. patent application Ser. No. 09/940,240, filed Aug. 27, 2001, now abandoned, which is a continuation of U.S. patent application Ser. No. 09/248,239, filed Feb. 10, 1999, now abandoned, which is a continuation-in-part of U.S. patent application Ser. No. 09/023,664, filed Feb. 10, 1998, now abandoned.

U.S. patent application Ser. No. 11/175,714, filed Jul. 5, 2005, is also a continuation-in-part of U.S. patent application Ser. No. 10/105,150, filed Mar. 25, 2002, now abandoned, which is a continuation of U.S. patent application Ser. No. 10/060,680, filed Jan. 30, 2002, now abandoned, which is a continuation of U.S. patent application Ser. No. 09/057,951, filed Apr. 9, 1998, now abandoned.

U.S. patent application Ser. No. 11/175,714, filed Jul. 5, 2005, is also a continuation-in-part of U.S. patent application Ser. No. 10/601,368, filed Jun. 23, 2003, now abandoned, which is a continuation of U.S. patent application Ser. No. 09/572,003, filed May 15, 2000, now abandoned, which is a continuation-in-part of U.S. patent application Ser. No. 09/561,263, filed Apr. 27, 2000, now abandoned, which is a continuation-in-part of U.S. patent application Ser. No. 09/322,790, filed May 28, 1999, now abandoned.

The entire contents of each of the above-listed patent applications are incorporated herein by reference.

The contents of the Sequence Listing are submitted herewith on compact disc in duplicate. Each duplicate disc has a copy of the file "sequence listing.txt" which is incorporated herein by this reference. This file is 961 kilobytes and was copied onto compact disc on Oct. 12, 2007.

BACKGROUND OF THE INVENTION

There is considerable medical interest in secreted and membrane-associated mammalian proteins. Many such proteins, for example, cytokines, are important for inducing the growth or differentiation of cells with which they interact or for triggering one or more specific cellular responses.

The demonstrated clinical utility of several secreted proteins in the treatment of human disease, for example, erythropoietin, granulocyte-macrophage colony stimulating factor (GM-CSF), human growth hormone, and various interleukins, illustrates the importance of secreted proteins.

Many membrane-associated proteins are receptors which bind a ligand(s) and transmit an intracellular signal. As such, membrane-associated proteins can be used to identify (or design) small molecules which act as agonists or antagonists of the ligand.

SUMMARY OF THE INVENTION

The present invention is based, at least in part, on the discovery of cDNA molecules which encode the TANGO 24 (DELTA3) protein.

Delta 3

The invention is based at least in part on the discovery of a human gene encoding a novel Delta protein, and its mouse homolog, each of which differs substantially from the previously described Delta proteins. Accordingly, the novel Delta proteins of the invention are referred to herein as Delta3 proteins. Thus, the invention provides Delta3 proteins, and nucleic acids encoding Delta3 proteins. An exemplary human Delta3 (hDelta3) is contained in a plasmid which was deposited with the ATCC® on Mar. 5, 1997, and has been assigned ATCC® accession number 98348.

Based on Northern blot analysis of RNA prepared from a number of human tissues, a 3.5 kb message was expressed in fetal brain, lung, liver and kidney; and adult heart, placenta, lung, skeletal muscle, kidney, pancreas, spleen, thymus, prostate, testis, ovary, small intestine and colon. In addition, the hDelta3 gene was found to be expressed at relatively high levels in at least some tumor cells (e.g., colon carcinoma) and its expression can be up-regulated in response to various growth factors (e.g., bFGF and VEGF). Furthermore, the expression of hDelta3 was also shown to increase in response to a signal-induced differentiation of endothelial cells, indicating a role for hDelta3 in modulating the growth and/or differentiation of cells, in particular endothelial cells.

In situ hybridization of a panel of adult and embryonic tissues using a probe complementary to mRNA of mDelta3 showed that mDelta3 expression was most abundant and widespread during embryogenesis. Strongest expression was observed in the eye during all stages of embryogenesis tested, mDelta3 was also seen in the developing lung, thymus and brown fat. In addition to the focal expression seen above, a multi-focal, scattered pattern was seen throughout the embryo. This signal pattern was more focused in the cortical region of the kidney and outlining the intestinal tract. Adult expression was highest in the ovary and the cortical regions of the kidney and adrenal gland. The expression seen during embryogenesis indicates that Delta3 has a role in cell growth and/or differentiation.

As demonstrated herein, Delta3 encodes a Notch ligand. In particular, data presented herein demonstrates that hDelta3 encodes a Notch ligand, as it has been shown to block the differentiation of C2C12 into myotubes in a similar fashion to other Notch ligands (e.g., Jagged 1).

As described herein, the hDelta3 gene has been localized by Southern blotting a membrane containing DNA from a panel of a human/hamster mono-chromosomal somatic cell hybrids. The results demonstrate that human Delta3 is located on human chromosome 15, close to framework markers D15S1244 and D15S144, a chromosomal region that has been associated with the neurological disease Agenesis of the Corpus Callosum with Peripheral Neuropathy (ACCPN) (Casaubon et al. (1996) Am J. Hum. Genet. 58:28). Accordingly, polymorphisms in Delta3 are thought to be involved in this neurological disease. As described further herein, Delta3 is also likely to be involved in other neurological diseases as well as in non-neurological diseases.

In one aspect, the invention features isolated Delta3 nucleic acid molecules, e.g., mammalian, such as human or mouse, Delta3 nucleic acids. The disclosed molecules can be non-coding, (e.g., probe, antisense or ribozyme molecules) or can encode a functional Delta3 polypeptide, e.g., a polypeptide which can modulate at least one activity of a Delta3 polypeptide. In one embodiment, the nucleic acid molecules hybridize to the Delta3 gene contained in the plasmid having American Type Culture Collection (ATCC®) Accession Number 98348. In another embodiment, the claimed nucleic acid is capable of hybridizing under stringent conditions to the nucleotide sequence set forth in SEQ ID NOS: 1, 3, 24, 26, 27, 29, 31, 33, 35, 37, 39, 41, 43 or 45, or the nucleotide sequence of the cDNA of a clone deposited with the ATCC® as Accession Number 98348, or to the complement thereof.

In further embodiments, the nucleic acid molecule is a Delta3 nucleic acid molecule that is at least about 50%, 55%, 60%, 70%, preferably 80%, more preferably 85%, and even more preferably at least about 95% or 98% identical to the nucleic acids shown in SEQ ID Nos: 1, 3, 24, 26, 27, 29, 31, 33, 35, 37, 39, 41, 43 or 45, or the nucleotide sequence of the cDNA of a clone deposited with the ATCC® as Accession Number 98348, or a complement thereof.

In another embodiment, the nucleic acid molecule is a Delta3 nucleic acid that is at least about 50%, 55%, 60%, 65%, 70%, preferably 80%, more preferably 85%, and even more preferably at least about 95% or 98% identical to the nucleic acids shown in SEQ ID NOS: 1, 3, 24, 26, 27, 29, 31, 33, 35, 37, 39, 41, 43 or 45, or the nucleotide sequence of the cDNA of a clone deposited with the ATCC® as Accession Number 98348 or a complement thereof, wherein such nucleic acid molecules encode polypeptides or proteins that exhibit at least one structural and/or functional feature of a polypeptide of the invention.

In another embodiment, the nucleic acid molecule encodes a polypeptide that is at least about 55%, 60%, 70%, preferably 80%, more preferably 85%, and even more preferably at least about 90, 95% or 98% identical to the polypeptide shown in SEQ ID NOS: 2, 25, 28, 30, 32, 34, 36, 38, 40, 42, 44 or 46, or the amino acid sequence encoded by the cDNA of a clone deposited with the ATCC® as Accession Number 98348, or a complement thereof.

In another embodiment, the nucleic acid molecule encodes a polypeptide that is at least about 55%, 60%, 70%, preferably 80%, more preferably 85%, and even more preferably at least about 90, 95% or 98% identical to the polypeptide shown in SEQ ID NOS: 2, 25, 28, 30, 32, 34, 36, 38, 40, 42, 44 or 46, or the amino acid sequence encoded by the cDNA of a clone deposited with the ATCC® as Accession Number 98348, or a complement thereof, wherein such nucleic acid molecules encode polypeptides or proteins that exhibit at least one structural and/or functional feature of a polypeptide of the invention. In another embodiment, the nucleic acid molecule encodes a polypeptide that is at least about 72%, preferably 80%, more preferably 85%, and even more preferably at least about 90 or 95% similar to the polypeptide shown in SEQ ID NOS: 2, 25, 28, 30, 32, 34, 36, 38, 40, 42, 44 or 46, or the hDelta 3 cDNA sequence contained in the plasmid having ATCC® Accession Number 98348, or a complement thereof.

In another embodiment, the nucleic acid molecule encodes a polypeptide that is at least about 72%, preferably 80%, more preferably 85%, and even more preferably at least about 90 or 95% similar to the polypeptide shown in SEQ ID NOS: 2, 25, 28, 30, 32, 34, 36, 38, 40, 42, 44 or 46, or the Delta 3 cDNA sequence contained in the plasmid having ATCC® Accession Number 98348, or a complement thereof, wherein such nucleic acid molecules encode polypeptides or proteins that exhibit at least one structural and/or functional feature of a polypeptide of the invention.

Also within the invention are nucleic acid molecules which encode a fragment of a polypeptide having the amino acid sequence of any of SEQ ID NOS: 2, 25, 28, 30, 32, 34, 36, 38, 40, 42, 44 or 46, the fragment including at least 15 (20, 25, 30, 35, 40, 45, 50, 55, 60, 65, 70, 75, 80, 85, 90, 95, 100, 110, 120, 130, 140, 150, 160, 170, 180, 190, 200, 210, 220, 230, 240, 250, 260, 270, 280, 290, 300, 310, 320, 330, 340, 350, 360, 370, 380, 390, 400, 410, 420, 440, 460, 475, 500, 525, 550, 575, 600, 625, 650, 675, or 685) contiguous amino acids of any of SEQ ID NOS: 2, 25, 28, 30, 32, 34, 36, 38, 40, 42, 44 or 46, or the polypeptide encoded by the cDNA of a clone deposited with the ATCC® as Accession Number 98348.

Also within the invention are nucleic acid molecules which encode a fragment of a polypeptide having the amino acid sequence of any of SEQ ID NOS: 2, 25, 28, 30, 32, 34, 36, 38, 40, 42, 44 or 46, the fragment including at least 15 (20, 25, 30, 35, 40, 45, 50, 55, 60, 65, 70, 75, 80, 85, 90, 95, 100, 110, 120, 130, 140, 150, 160, 170, 180, 190, 200, 210, 220, 230, 240, 250, 260, 270, 280, 290, 300, 310, 320, 330, 340, 350, 360, 370, 380, 390, 400, 410, 420, 440, 460, 475, 500, 525, 550, 575, 600, 625, 650, 675, or 685) contiguous amino acids of any of SEQ ID NOS: 2, 25, 28, 30, 32, 34, 36, 38, 40, 42, 44 or 46, or the polypeptide encoded by the cDNA of a clone deposited with the ATCC® as Accession Number 98348, wherein the fragment exhibits at least one structural and/or functional feature of a polypeptide of the invention.

The nucleic acids of the invention can comprise a nucleotide sequence encoding at least one domain or motif of a Delta3 protein, i.e., a domain or motif selected from the group consisting of an amino-terminal signal peptide, a Delta-Serrated lag-2 (DSL) domain, Epidermal Growth Factor (EGF)-like domain 1, EGF-like domain 2, EGF-like domain 3, EGF-like domain 4, EGF-like domain 5, EGF-like domain 6, EGF-like domain 7, EGF-like domain 8, a Delta3 extracellular domain, a transmembrane domain (TM), and a cytoplasmic domain. Other nucleic acids of the invention encode soluble Delta3 proteins, e.g., Delta3 proteins comprising at least a portion, such as one or more domains, of the extracellular domain of a Delta3 protein. A soluble Delta3 protein is a protein that is soluble at standard physiological conditions, and includes, but is not limited to a Delta3 protein that does not comprise a transmembrane domain, e.g., an extracellular Delta3 domain. These soluble polypeptides may or may not comprise a signal peptide. Other such nucleic acids encode soluble fusion proteins comprising Delta3 amino acid sequence and a heterologous amino acid sequence, e.g., an immunoglobulin constant region.

The invention also provides probes and primers comprising substantially purified oligonucleotides, which correspond to a region of nucleotide sequence which hybridizes to at least about 6 consecutive nucleotides of the sequences set forth as SEQ ID NOs: 1, 3, 24, 26, 27, 29, 31, 33, 35, 37, 39, 41, 43 or 45, or the nucleotide sequence of the cDNA of a clone deposited with the ATCC® as Accession Number 98348, or a complement thereof, or naturally-occurring mutants thereof. In preferred embodiments, the probe/primer further includes a label group attached thereto, which is capable of being detected.

The invention features nucleic acid molecules of at least 425, 450, 500, 550, 600, 650, 700, 750, 800, 850, 900, 950, 1000, 1100, 1200, 1300, 1400, 1500, 1600, 1700, 1800, 1900, 2000, 2100, 2200, 2300, 2400, 2500, 2600, 2700, or 2800 nucleotides of the nucleotide sequence of SEQ ID NO: 1, the nucleotide sequence of the human Delta3 cDNA clone of ATCC® Accession NO: 98348, or a complement thereof. The invention also features nucleic acid molecules comprising at least 25, 50, 100, 150, 200, 250, 300, 350, 400, 450, 500, 600, 650, 700, 750, 800, 850, 900, 950, 1000, 1050, 1100, 1150, 1200, 1250, 1300, 1350, 1400, 1450, 1500, 1550, 1600, 1650, 1700, 1750, 1800, 1850, 1900, 1950, 2000, 2050 or 2061 nucleotides of nucleic acids 1 to 2062 of SEQ ID NO: 1, or a complement thereof, wherein such nucleic acid molecules encode polypeptides or proteins that exhibit at least one structural and/or functional feature of a polypeptide of the invention.

The invention features nucleic acid molecules which include a fragment of at least 340, 400, 450, 500, 550, 600, 650, 700, 750, 800, 850, 900, 950, 1000, 1050, 1100, 1150, 1200, 1250, 1300, 1350, 1400, 1450, 1450, 1500, 1550, 1600, 1650, 1700, 1750, 1800, 1850, 1900, 1950, 2000, 2050 or 2058 nucleotides of the nucleotide sequence of SEQ ID NO:3, or a complement thereof. The invention also features nucleic acid molecules comprising at least 25, 50, 100, 150, 200, 250, 300, 350, 400, 450, 500, 600, 650, 700, 750, 800, 850, 900, 950, 1000, 1050, 1100, 1150, 1200, 1250, 1300, 1350, 1400, 1450, 1500, 1550, 1600, 1650, 1700, or 1724 nucleotides of nucleic acids 1 to 1725 of SEQ ID NO:3, or a complement thereof.

The invention features nucleic acid molecules of at least 480, 500, 550, 600, 650, 700, 750, 800, 850, 900, 950, 1000, 1050, 1100, 1150, 1200, 1250, 1300, 1350, 1400, 1450, 1450, 1500, 1550, 1600, 1650, 1700, 1750, 1800, 1850, 1900, 1950, 2000, 2050, 2100, 2200, 2300, 2400, 2500, 2600, 2700, 2800, 2900, 3000, 3100 or 3130 nucleotides of the nucleotide sequence of SEQ ID NO:24, the nucleotide sequence of the mouse Delta3 cDNA, or a complement thereof. The invention also features nucleic acid molecules comprising at least 25, 50, 100, 150, 200, 250, 300, 350, 400, 450, 500, 600, 650, 700, 750, 800, 850, 900, 950, 1000, 1050, 1100, 1150, 1200, 1250, 1300, 1350, 1400, 1450, 1500, or 1529 nucleotides of nucleic acids 1 to 1530 of SEQ ID NO:24, or a complement thereof, wherein such nucleic acid molecules encode polypeptides or proteins that exhibit at least one structural and/or functional feature of a polypeptide of the invention.

The invention features nucleic acid molecules which include a fragment of at least 415, 450, 500, 550, 600, 650, 700, 750, 800, 850, 900, 950, 1000, 1050, 1100, 1150, 1200, 1250, 1300, 1350, 1400, 1450, 1450, 1500, 1550, 1600, 1650, 1700, 1750, 1800, 1850, 1900, 1950, 2000, 2050, 2100 nucleotides of the nucleotide sequence of SEQ ID NO: 26, or a complement thereof. The invention also features nucleic acid molecules comprising at least 25, 50, 100, 150, 200, 250, 300, 350, 400, 450, 500, 600, 650, 700, 750, 800, 850, 900, 950, 1000, 1050, 1100, 1150, 1200, 1250, 1300, 1350, 1400, 1450, 1500 or 1529 nucleotides of nucleic acids 1 to 1530 of SEQ ID NO: 3, or a complement thereof.

Another aspect of the invention provides vectors, e.g., recombinant expression vectors, comprising a nucleic acid molecule of the invention. In another embodiment the invention provides host cells containing such a vector. The invention also provides methods for producing a polypeptide of the invention by culturing, in a suitable medium, a host cell of the invention containing a recombinant expression vector encoding a polypeptide of the invention such that the polypeptide of the invention is produced.

For expression, the subject Delta3 nucleic acids can include a mammalian transcriptional regulatory sequence, e.g., at least one of a transcriptional promoter (e.g., for constitutive expression or inducible expression) or transcriptional enhancer sequence, the regulatory sequence is operably linked to the Delta3 gene sequence. Such regulatory sequences in conjunction with Delta3 nucleic acid molecules can be useful in vectors for gene expression. This invention also describes host cells transfected with said expression vectors whether prokaryotic or eukaryotic, also in vitro (e.g., cell culture) and in vivo (e.g., transgenic) methods for producing Delta3 proteins by employing said expression vectors. In a preferred embodiment, the Delta3 nucleic acids are cloned into a mammalian expression vector, and transfected into mammalian cells. The use of mammalian cells increases the likelihood of proper protein folding and post-translational modification of the expressed proteins.

The invention also features nucleic acid molecules that hybridize under stringent conditions to a nucleic acid molecule comprising the nucleotide sequence of any of SEQ ID NOS: 1, 3, 24, 26, 27, 29, 31, 33, 35, 37, 39, 41, 43 or 45 of the cDNA of a clone deposited with the ATCC® as Accession Number 98348, or a complement thereof, wherein preferably such nucleic acid molecules encode polypeptides or proteins that exhibit at least one structural and/or functional feature of a polypeptide of the invention. In other embodiments, the nucleic acid molecules are at least 485 (500, 550, 600, 650, 700, 800, 900, 1000, 1100, 1200, 1300, 1400, 1500, 1600, 1700, 1800, 1900, 2000, 2100, 2200, 2300, 2400, 2500, 2600, 2700, or 2800) nucleotides in length and hybridize under stringent conditions to a nucleic acid molecule comprising the nucleotide sequence of any of SEQ ID NOS: 1, 3, 24, 26, 27, 29, 31, 33, 35, 37, 39, 41, 43 or 45 of the cDNA of a clone deposited with the ATCC® as Accession Number 98348, or a complement thereof.

In preferred embodiments, the isolated nucleic acid molecules encode a cytoplasmic, transmembrane, or extracellular domain of a polypeptide of the invention.

The invention includes nucleic acid molecules which encode an allelic variant of a polypeptide comprising the amino acid sequence of any of SEQ ID NOS: 2, 25, 28, 30, 32, 34, 36, 38, 40, 42, 44 or 46, or an amino acid sequence encoded by the cDNA of a clone deposited with the ATCC® as Accession Number 98348, or a complement thereof, wherein the nucleic acid molecule hybridizes under stringent conditions to a nucleic acid molecule having a nucleic acid sequence encoding any of SEQ ID NOS:1, 3, 24, 26, 27, 29, 31, 33, 35, 37, 39, 41, 43 or 45, or the nucleotide sequence of the cDNA of a clone deposited with the ATCC® as Accession Number 98348, or a complement thereof.

The invention includes nucleic acid molecules which encode an allelic variant of a polypeptide comprising the amino acid sequence of any of SEQ ID NOS: 2, 25, 28, 30, 32, 34, 36, 38, 40, 42, 44 or 46, or an amino acid sequence encoded by the cDNA of a clone deposited with the ATCC® as Accession Number 98348, or a complement thereof, wherein the nucleic acid molecule hybridizes under stringent conditions to a nucleic acid molecule having a nucleic acid sequence encoding a polypeptide having any of the amino acid sequences shown in SEQ ID NOS: 2, 25, 28, 30, 32, 34, 36, 38, 40, 42, 44 or 46, or the amino acid sequence encoded by the cDNA of a clone deposited with the ATCC® as Accession Number 98348, or a complement thereof, wherein such nucleic acid molecules encode polypeptides or proteins that exhibit at least one structural and/or functional feature of a polypeptide of the invention.

In one embodiment of a nucleotide sequence of human Delta3, the nucleotide at position 455 is a guanine (G) (SEQ ID NO: 1). In this embodiment, the amino acid at position 40 is glutamate (E) (SEQ ID NO: 2). In another embodiment of a nucleotide sequence of human Delta3, the nucleotide at position 455 is a cytosine (C) (SEQ ID NO: 27). In this embodiment, the amino acid at position 40 is glutamine (Q) (SEQ ID NO: 28). In another embodiment of a nucleotide sequence of human Delta3, the nucleotide at position 455 is a thymidine (T) (SEQ ID NO: 29). In this embodiment, the amino acid at position 40 is a stop codon (SEQ ID NO: 30). In another embodiment of a nucleotide sequence of human Delta3, the nucleotide at position 455 is a adenine (A) (SEQ ID NO: 31). In this embodiment, the amino acid at position 40 is lysine (K) (SEQ ID NO: 32).

In another embodiment, the invention provides an isolated nucleic acid molecule which is antisense to the coding strand of a nucleic acid of the invention.

In another aspect, the invention features isolated Delta3 polypeptides, preferably substantially pure preparations, e.g., of plasma-purified or recombinantly produced Delta3 polypeptides. Preferred proteins and polypeptides possess at least one biological activity of the corresponding naturally-occurring human polypeptide. Such an activity can be a direct activity, such as an association with or an enzymatic activity on a second protein or an indirect activity, such as a cellular signaling activity mediated by interaction of the protein with a second protein. Thus, such activities include, for example, ones related to Delta3's function as a Notch ligand. Delta3 activities include, e.g., (1) the ability to form protein-protein interactions with proteins in the signaling pathway of the naturally-occurring polypeptide; (2) the ability to bind a ligand of the naturally-occurring polypeptide; (3) the ability to bind to an intracellular target of the naturally-occurring polypeptide; (4) the ability to modulate cellular proliferation; (5) the ability to modulate cellular differentiation; (6) the ability to modulate chemotaxis and/or migration; and/or (7) the ability to modulate cell death; (8) maintenance of energy homeostasis (e.g., regulating the balance or imbalance between energy storage and energy expenditure, for example, increasing or decreasing energy expenditure; (9) regulation of adaptive thermogenesis (e.g., regulation of the biogenesis of mitochondria, regulation of the expression of mitochondrial enzymes, regulation of expression of uncoupling proteins; (10) regulation of adiposity; (11) modulation of the efficiency of energy storage; (12) regulation of appetite; (13) expansion/reduction of fat mass; (14) regulation of vasculogenesis (blood vessel formation); (15) regulation of tumor angiogenesis; (16) regulation of wound healing; (17) expansion/reduction of tumor mass; (18) the ability to modulate development, differentiation, proliferation and/or activity of immune cells (e.g., leukocytes and macrophages), endothelial cells and smooth muscle cells; (19) the ability to modulate the host immune response; (20) the ability to modulate the development of organs, tissues and/or cells of the embryo and/or fetus; (21) the ability to modulate cell-cell interactions and/or cell-extracellular matrix interactions; (22) the ability to modulate atherosclerosis, e.g., the initiation and progression of atherosclerosis; (23) the ability to modulate atherogenesis; (24) the ability to modulate inflammatory functions e.g., by modulating leukocyte adhesion to extracellular matrix and/or endothelial cells; (25) the ability to form, e.g., stabilize, promote, facilitate, inhibit, or disrupt, cell to cell and cell to blood product interaction, e.g., between leukocytes and platelets or leukocytes and vascular endothelial cells; (26) ability to modulate development, differentiation and activity of skeletal muscle cells and tissue; and (27) ability to act in stem cell preservation.

In certain embodiments, the subject polypeptides are capable of modulating an activity of a Delta3 polypeptide, e.g., cell growth and/or differentiation or induction of apoptosis. In other embodiments, the subject Delta3 polypeptides can modulate neurogenesis (e.g., by inhibiting Notch expressing cells from becoming committed to a neural fate). In addition, Delta3 polypeptides which specifically antagonize the activity of a native Delta3 polypeptide, such as may be provided by truncation mutants or other dominant negative mutants, are also specifically provided herein.

In one embodiment, a polypeptide of the invention has an amino acid sequence sufficiently identical to an identified domain of a polypeptide of the invention. As used herein, the term "sufficiently identical" refers to a first amino acid or nucleotide sequence which contains a sufficient or minimum number of identical or equivalent (e.g., with a similar side chain) amino acid residues or nucleotides to a second amino acid or nucleotide sequence such that the first and second amino acid or nucleotide sequences have a common structural domain and/or common functional activity. For example, amino acid or nucleotide sequences which contain a common structural domain having about 65% identity, preferably 75% identity, more preferably 85%, 95%, or 98% identity.

In one embodiment, the polypeptide is identical to a Delta3 protein represented in SEQ ID NOs: 2, 25, 28, 30, 32, 34, 36, 38, 40, 42, 44 or 46, or the amino acid sequence encoded by the cDNA of a clone deposited with the ATCC® as Accession Number 98348. Preferably, a Delta3 polypeptide has an amino acid sequence, which is at least about 55%, 60%, 70%, preferably at least about 80%, more preferably at least about 90%, and even more preferably at least about 95% or 98% identical to the polypeptide represented by SEQ ID NOs: 2, 25, 28, 30, 32, 34, 36, 38, 40, 42, 44 or 46, or the amino acid sequence encoded by the cDNA of a clone deposited with the ATCC® as Accession Number 98348.

Also within the invention are isolated polypeptides or proteins having an amino acid sequence that is at least about 55%, preferably 65%, 75%, 85%, 95%, or 98% identical to the amino acid sequence of any of SEQ ID NOs: 2, 25, 28, 30, 32, 34, 36, 38, 40, 42, 44 or 46, or the amino acid sequence encoded by the cDNA of a clone deposited with the ATCC® as Accession Number 98348, wherein the polypeptides or proteins also exhibit at least one structural and/or functional feature of a polypeptide of the invention.

Also within the invention are isolated polypeptides or proteins which preferably are encoded by a nucleic acid molecule having a nucleotide sequence that is at least about 55%, more preferably 60%, 65%, 75%, 85%, or 95% identical the nucleic acid sequence encoding any of SEQ ID NOs: 2, 25, 28, 30, 32, 34, 36, 38, 40, 42, 44 or 46, wherein the polypeptides or proteins preferably also exhibit at least one structural and/or functional feature of the invention, and isolated polypeptides or proteins which are encoded by a nucleic acid molecule having a nucleotide sequence which hybridizes under stringent hybridization conditions to a nucleic acid molecule having the sequence of any of SEQ ID NOs: 1, 3, 24, 26, 27, 29, 31, 33, 35, 37, 39, 41, 43 or 45, or a complement thereof, or the non-coding strand of the cDNA of a clone deposited with the ATCC® as Accession Number 98348.

In a preferred embodiment, the Delta3 polypeptide is encoded by a nucleic acid which hybridizes in high stringency conditions with a nucleic acid sequence represented in one of SEQ ID NOs: 1, 3, 24, 26, 27, 29, 31, 33, 35, 37, 39, 41, 43 or 45 or with the nucleic acid contained in the plasmid having ATCC® Accession NO: 98348.

The subject Delta3 proteins also include modified proteins, which are resistant to post-translational modification, as for example, due to mutations which alter modification sites (such as tyrosine, threonine, serine or asparagine residues), or which prevent glycosylation of the protein, or which prevent interaction of the protein with intracellular proteins involved in signal transduction.

The Delta3 polypeptide can comprise a full-length protein, such as represented in SEQ ID NO: 2, 25, 28, 30, 32, 34, 36, 38, 40, 42, 44 or 46, or it can comprise a fragment corresponding to one or more particular motifs/domains (e.g., an extracellular domain, a DSL domain or an EGF-like domain, all of which are described below), or to other sizes, e.g., at least 5, 10, 25, 50, 100, 150, 200, 250, 300, 350, 400, 450, 500, 550, 600 or 650 amino acids in length.

The polypeptides of the invention can comprise at least one domain or motif of a Delta3 protein, i.e., a domain or motif selected from the group consisting of an amino-terminal signal peptide, a Delta-Serrated lag-2 (DSL) domain, Epidermal Growth Factor (EGF)-like domain 1, EGF-like domain 2, EGF-like domain 3, EGF-like domain 4, EGF-like domain 5, EGF-like domain 6, EGF-like domain 7, EGF-like domain 8, a Delta3 extracellular domain, a transmembrane domain (TM), and a cytoplasmic domain. Other polypeptides comprise soluble Delta3 proteins, e.g., Delta3 proteins comprising at least a portion, such as one or more domains, of the extracellular domain of a Delta3 protein. A soluble Delta3 protein is a protein that is soluble at physiological conditions, and includes but is not limited to a Delta3 protein that does not comprise a transmembrane domain, e.g., an extracellular Delta3 domain. These soluble polypeptides may or may not comprise a signal peptide. Other such polypeptides comprise soluble fusion proteins comprising Delta3 amino acid sequence and a heterologous amino acid sequence, e.g., an immunoglobulin constant region.

In one embodiment, the isolated polypeptide of the invention lacks both a transmembrane and a cytoplasmic domain. In another embodiment, the polypeptide lacks both a transmembrane domain and a cytoplasmic domain and is soluble under physiological conditions.

Also within the invention are polypeptides which are allelic variants of a polypeptide that includes the amino acid sequence of any of SEQ ID NOs: 2, 25, 28, 30, 32, 34, 36, 38, 40, 42, 44 or 46, or an amino acid sequence encoded by the cDNA of a clone deposited with the ATCC® as Accession Number 98348, wherein the polypeptide is encoded by a nucleic acid molecule which hybridizes under stringent conditions to a nucleic acid molecule having the sequence of any of SEQ ID NOs: 1, 3, 24, 26, 27, 29, 31, 33, 35, 37, 39, 41, 43 or 45, or the nucleotide sequence of the cDNA of a clone deposited with the ATCC® as Accession Number 98348, or a complement thereof.

Also within the invention are polypeptides which are allelic variants of a polypeptide that includes the amino acid sequence of any of SEQ ID NOs: 2, 25, 28, 30, 32, 34, 36, 38, 40, 42, 44 or 46, or an amino acid sequence encoded by the cDNA of a clone deposited with the ATCC® as Accession Number 98348, wherein the polypeptide is encoded by a nucleic acid molecule which hybridizes under stringent conditions to a nucleic acid molecule having the sequence of any of SEQ ID NOs: 1, 3, 24, 26, 27, 29, 31, 33, 35, 37, 39, 41, 43 or 45, or the nucleotide sequence of the cDNA of a clone deposited with the ATCC® as Accession Number 98348, or a complement thereof, wherein such nucleic acid molecules encode polypeptides or proteins that exhibit at least one structural and/or functional feature of a polypeptide of the invention.

Another aspect of the invention features fusion proteins comprising a Delta3 amino acid sequence. For instance, the Delta3 protein can be provided as a recombinant fusion protein which includes a second polypeptide portion, e.g., a second polypeptide having an amino acid sequence unrelated (heterologous) to the Delta3 polypeptide, (e.g., the second polypeptide portion is glutathione-S-transferase, an enzymatic sequence such as alkaline phosphatase or an epitope tag).

Fusion proteins of the invention include, for example, Delta3 immunoglobulin (Delta3-Ig) fusion proteins. For example, a Delta3 fusion protein can comprise the extracellular portion of a Delta3 protein fused to the constant region of an immunoglobulin molecule. Preferred extracellular portions comprise at least one domain selected from the group consisting of a signal peptide, a DSL domain, and the eight EGF-like domains of a Delta3 protein. An even more preferred extracellular domain comprises an amino acid sequence from amino acid 1 to amino acid 529 of SEQ ID NO: 2 or from amino acid 1 to 530 of SEQ ID NO: 25. Yet other preferred Delta3 fusion proteins comprise a portion of a Delta3 protein that is sufficient for binding to a second protein, such as the DSL domain to a second protein which is, for example, a Notch protein.

Yet another aspect of the present invention concerns an immunogen comprising a Delta3 polypeptide in an immunogenic preparation, the immunogen being capable of eliciting an immune response specific for a Delta3 polypeptide, e.g., a humoral response, an antibody response and/or cellular response. In preferred embodiments, the immunogen comprises an antigenic determinant, e.g., a unique determinant, from the protein represented by SEQ ID NOs: 2, 25, 28, 30, 32, 34, 36, 38, 40, 42, 44 or 46, or the amino acid sequence encoded by the cDNA of a clone deposited with the ATCC® as Accession Number 98348.

A still further aspect of the present invention features antibodies and antibody preparations specifically reactive with an epitope of the Delta3 protein. In preferred embodiments, the antibody specifically binds to an epitope of a polypeptide shown in SEQ ID NOs: 2, 25, 28, 30, 32, 34, 36, 38, 40, 42, 44 or 46, or the amino acid sequence encoded by the cDNA of a clone deposited with the ATCC® as Accession Number 98348.

In yet a further aspect, the invention provides substantially purified antibodies or fragments thereof, including human or non-human antibodies or fragments thereof, which antibodies or fragments specifically bind to a polypeptide comprising an amino acid sequence selected from the group consisting of: the amino acid sequence of SEQ ID NOs: 2, 25, 28, 30, 32, 34, 36, 38, 40, 42, 44 or 46, or the amino acid sequence encoded by the cDNA insert of the plasmid deposited with the ATCC® as Accession Number 98348; a fragment of at least 15 amino acid residues of the amino acid sequence of SEQ ID NOs: 2, 25, 28, 30, 32, 34, 36, 38, 40, 42, 44 or 46, or the amino acid sequence encoded by the cDNA of a clone deposited with the ATCC® as Accession Number 98348; an amino acid sequence which is at least 95% identical to the amino acid sequence of SEQ ID NOs: 2, 25, 28, 30, 32, 34, 36, 38, 40, 42, 44 or 46, or the amino acid sequence encoded by the cDNA of a clone deposited with the ATCC® as Accession Number 98348 wherein the percent identity is determined using the ALIGN program of the GCG software package with a PAM120 weight residue table, a gap length penalty of 12, and a gap penalty of 4; and an amino acid sequence which is encoded by a nucleic acid molecule which hybridizes to the nucleic acid molecule consisting of SEQ ID NOs: 1, 3, 24, 26, 27, 29, 31, 33, 35, 37, 39, 41, 43 or 45, or the nucleotide sequence of the cDNA of a clone deposited with the ATCC® as Accession Number 98348, under conditions of hybridization of 6×SSC at 45° C. and washing in 0.2×SSC, 0.1% SDS at 65° C. In various embodiments, the substantially purified antibodies of the invention, or fragments thereof, can be human, non-human, chimeric and/or humanized antibodies.

In another aspect, the invention provides human or non-human antibodies or fragments thereof, which antibodies or fragments specifically bind to a polypeptide comprising an amino acid sequence selected from the group consisting of: the amino acid sequence of SEQ ID NOs: 2, 25, 28, 30, 32, 34, 36, 38, 40, 42, 44 or 46, or the amino acid sequence encoded by the cDNA insert of the plasmid deposited with the ATCC® as Accession Number 98348; a fragment of at least 15 amino acid residues of the amino acid sequence of SEQ ID NOs: 2, 25, 28, 30, 32, 34, 36, 38, 40, 42, 44 or 46, or the amino acid sequence encoded by the cDNA of a clone deposited with the ATCC® as Accession Number 98348; an amino acid sequence which is at least 95% identical to the amino acid sequence of SEQ ID NOs: 2, 25, 28, 30, 32, 34, 36, 38, 40, 42, 44 or 46, or the amino acid sequence encoded by the cDNA of a clone deposited with the ATCC® as Accession Number 98348 wherein the percent identity is determined using the ALIGN program of the GCG software package with a PAM 120 weight residue table, a gap length penalty of 12, and a gap penalty of 4; and an amino acid sequence which is encoded by a nucleic acid molecule which hybridizes to the nucleic acid molecule consisting of SEQ ID NOs: 1, 3, 24, 26, 27, 29, 31, 33, 35, 37, 39, 41, 43 or 45, or the nucleotide sequence of the cDNA of a clone deposited with the ATCC® as Accession Number 98348, under conditions of hybridization of 6×SSC at 45° C. and washing in 0.2×SSC, 0.1% SDS at 65° C. With respect to non-human antibodies, such antibodies can be goat, mouse, sheep, horse, chicken, rabbit, or rat antibodies. Alternatively, the non-human antibodies of the invention can be chimeric and/or humanized antibodies. In addition, the human and non-human antibodies of the invention can be polyclonal antibodies or monoclonal antibodies.

In still a further aspect, the invention provides monoclonal antibodies or fragments thereof, which antibodies or fragments specifically bind to a polypeptide comprising an amino acid sequence selected from the group consisting of: the amino acid sequence of SEQ ID NOs: 2, 25, 28, 30, 32, 34, 36, 38, 40, 42, 44 or 46, or the amino acid sequence encoded by the cDNA insert of the plasmid deposited with the ATCC® as Accession Number 98348; a fragment of at least 15 amino acid residues of the amino acid sequence of SEQ ID NOs: 2, 25, 28, 30, 32, 34, 36, 38, 40, 42, 44 or 46; an amino acid sequence which is at least 95% identical to the amino acid sequence of SEQ ID NOs: 2, 25, 28, 30, 32, 34, 36, 38, 40, 42, 44 or 46, or the amino acid sequence encoded by the cDNA of a clone deposited with the ATCC® as Accession Number 98348, wherein the percent identity is determined using the ALIGN program of the GCG software package with a PAM120 weight residue table, a gap length penalty of 12, and a gap penalty of 4; and an amino acid sequence which is encoded by a nucleic acid molecule which hybridizes to the nucleic acid molecule consisting of SEQ ID NOs: 1, 3, 24, 26, 27, 29, 31, 33, 35, 37, 39, 41, 43 or 45, or the nucleotide sequence of the cDNA of a clone deposited with the ATCC® as Accession Number 98348, under conditions of hybridization of 6×SSC at 45° C. and washing in 0.2×SSC, 0.1% SDS at 65° C. The monoclonal antibodies can be human, humanized, chimeric and/or non-human antibodies.

In a particularly preferred embodiment, the substantially purified antibodies or fragments thereof, the human and non-human antibodies or fragments thereof, and/or monoclonal antibodies or fragments thereof, of the invention specifically bind to an extracellular domain of the amino acid sequence of SEQ ID NOs: 2, 25, 28, 30, 32, 34, 36, 38, 40, 42, 44 or 46, or the amino acid sequence encoded by the cDNA of a clone deposited with the ATCC® as Accession Number 98348. Preferably, the extracellular domain to which the antibody, or fragment thereof, binds comprises amino acid residues 1-529 of SEQ ID NO: 2 of human Delta3, or amino acid residues 1-530 of SEQ ID NO: 25 of murine Delta3.

Any of the antibodies of the invention can be conjugated to a therapeutic moiety or to a detectable substance. Non-limiting examples of detectable substances that can be conjugated to the antibodies of the invention are an enzyme, a prosthetic group, a fluorescent material, a luminescent material, a bioluminescent material, and a radioactive material.

The invention also provides a kit containing an antibody of the invention and instructions for use. Such kits can also comprise an antibody of the invention conjugated to a detectable substance and instructions for use. Still another aspect of the invention is a pharmaceutical composition comprising an antibody of the invention and a pharmaceutically acceptable carrier. In preferred embodiments, the pharmaceutical composition contains an antibody of the invention, a therapeutic moiety, and a pharmaceutically acceptable carrier.

In addition, the polypeptides of the invention or biologically active portions thereof, or antibodies of the invention, can be incorporated into pharmaceutical compositions, which optionally include pharmaceutically acceptable carriers.

The invention also features transgenic non-human animals which include (and preferably express) a heterologous form of a Delta3 gene described herein, or which misexpress (e.g., do not express) an endogenous Delta3 gene (e.g., an animal in which expression of one or more of the subject Delta3 proteins is disrupted). Such a transgenic animal can serve as an animal model for studying cellular or tissue disorders comprising mutated or mis-expressed Delta3 alleles or for use in drug screening. For example, the transgenic animals of the invention can be used as an animal model to study a neurological disease, e.g., ACCPN. Alternatively, such a transgenic animal can be useful for expressing recombinant polypeptides, and for generating cells, e.g., cell lines that can, for example, be utilized as part of screening techniques.

In another aspect, the invention provides a method for identifying a compound that binds to or modulates the activity of a polypeptide of the invention. In general, such methods entail measuring a biological activity of the polypeptide in the presence and absence of a test compound and identifying those compounds which alter the activity of the polypeptide.

The invention also features methods for identifying a compound which modulates the expression of a polypeptide or nucleic acid of the invention by measuring the expression of the polypeptide or nucleic acid in the presence and absence of the compound.

In one embodiment, the invention provides assays, e.g., for screening test compounds to identify agonists, or alternatively, antagonists, of a Delta3 activity. For example, the test compound may positively or negatively influence an interaction between a Delta3 protein and a Delta3 target molecule, for example, a Notch protein. An exemplary method includes the steps of (i) combining a Delta3 polypeptide or active fragment thereof, with a Delta3 target molecule, e.g., Notch, and a test compound, e.g., under conditions wherein, but for the test compound, the Delta3 protein and target molecule are able to interact; and (ii) detecting the formation of a complex which includes the Delta3 protein and the target molecule either by directly quantitating the complex, by measuring inductive effects of the Delta3 protein, or, in the instance of a substrate, measuring the conversion to product. A statistically significant change, such as a decrease, in the interaction of the Delta3 and target molecule in the presence of a test compound (relative to what is detected in the absence of the test compound) is indicative of a modulation (e.g., suppression or potentiation of the interaction between the Delta3 protein and the target molecule).

The invention provides yet other methods for identifying compounds which modulate a Delta activity. For example, a compound that interacts with a Delta3 protein can be identified by contacting a Delta3 protein with a test compound. Either the test compound or the Delta3 protein can be labeled. Optionally, the non-labeled compound or Delta3 protein can be attached to a solid phase support. Binding of the test compound to the Delta3 protein can then be determined, e.g. by measuring the amount of label. Such a Delta3 binding molecule can be an agonist or an antagonist. In one embodiment, an agonist of a Delta3 activity is identified by contacting a cell having a Delta3 protein with a test compound and measuring a Delta3 activity, e.g., expression of a gene which is regulated by binding of a protein, e.g., a Notch protein, to Delta3. An increased expression of the gene when the cell is incubated with the test compound relative to incubation in the absence of the test compound indicates that the test compound is a Delta3 agonist. The gene that is monitored can also be a reporter gene transfected to a cell, the reporter gene being under the control of a promoter of a gene which is regulated by Delta3.

In another aspect, the invention provides methods for modulating activity of a polypeptide of the invention comprising contacting a cell with an agent that modulates (inhibits or stimulates) the activity or expression of a polypeptide of the invention such that activity or expression in the cell is modulated. In one embodiment, the agent is an antibody that specifically binds to a polypeptide of the invention.

In another embodiment, the agent modulates expression of a polypeptide of the invention by modulating transcription, splicing, or translation of an mRNA encoding a polypeptide of the invention. In yet another embodiment, the agent is a nucleic acid molecule having a nucleotide sequence that is antisense to the coding strand of an mRNA encoding a polypeptide of the invention.

Yet another aspect of the present invention concerns methods for treating diseases or conditions that are caused or contributed to by an aberrant Delta3 expression, level, or activity, e.g., aberrant cell proliferation, degeneration or differentiation, in a subject, by administering to the subject an effective amount of a modulator (e.g., an agonist or antagonist) of a Delta3 activity. In one embodiment, an agonist or antagonist can modulate Delta3 protein levels, by, e.g., modulating expression of a Delta3 gene. A modulator can, for example, be a protein of the invention, or, alternatively, a nucleic acid of the invention. In other embodiments, the modulator is a peptide, antibody, peptidomimetic, or other small organic molecule. For example, administration of a therapeutic comprised of a Delta3 agonist can be useful for promoting the tissue regeneration or repair needed to effectively treat a nerve injury, neurodegenerative disease, or neurodevelopmental disorder including but not limited to peripheral neuropathies, e.g., ACCPN, stroke, dementia, Alzheimer's disease, Parkinson's disease, Huntington's chorea, amylotrophic lateral sclerosis, and the like, as well as spinocerebellar degenerations.

Alternatively, administration of a Delta3 antagonist may be to effectively treat a neoplastic or hyperplastic disease, particularly of endothelial tissue.

Additionally, Delta3 agonists or antagonists may be used to treat various hematologic abnormalities such as neutropenia seen in patients undergoing chemotherapy, or immunodeficiency disorders such as AIDS. Delta3 nucleic acids, polypeptides or modulators thereof can also be utilized in treating or ameliorating a symptom of obesity and/or disorders that accompany or are exacerbated by an obese state, such as cardiovascular and circulatory disorders, metabolic abnormalities typical of obesity, such as hyperinsulinemia, insulin resistance, diabetes, including non-insulin dependent diabetes mellitus (NIDDM), insulin dependent diabetes mellitus (IDDM), and maturity onset diabetes of the young (MODY), disorders of energy homeostasis, disorders associated with lipid metabolism, such as cachexia, disorders associated with abnormal vasculogenesis (e.g., cancers, including, but not limited to, cancers of the epithelia (e.g., carcinomas of the pancreas, stomach, liver, secretory glands (e.g., adenocarcinoma), bladder, lung, breast, skin (e.g., fibromatosis or malignant melanoma), reproductive tract including prostate gland, ovary, cervix and uterus); cancers of the hematopoietic and immune system (e.g., leukemias and lymphomas); cancers of the central nervous, brain system and eye (e.g., gliomas, neuroblastoma and retinoblastoma); and cancers of connective tissues, bone, muscles and vasculature (e.g., hemangiomas and sarcomas)), disorders related to fetal development, in particular, disorders involving development of lung and kidney, lung-related disorders, atherosclerosis, e.g., the initiation and progression of atherosclerosis; and inflammatory-related disorders, e.g., asthma, allergy, and autoimmune disorders, neurological disorders, including developmental, cognitive and personality-related disorders, renal disorders, adrenal gland-related disorders; and disorders relating to skeletal muscle, such as dystrophic disorders.

The invention also provides methods for treating diseases or conditions associated with one or more specific Delta alleles, e.g., mutant allele, comprising administering to the subject an effective amount of a therapeutic compound. In one embodiment, the therapeutic compound is capable of compensating for the effect of the specific Delta allele. In another embodiment, the therapeutic compound is capable of modulating a Delta3 activity. In a one embodiment, the Delta allele is a Delta3 allele. For example, in one embodiment, the disease or condition is a neurological disease, e.g., ACCPN.

A further aspect of the present invention provides a method for determining whether a subject is at risk for developing a disease or condition, which is caused by or contributed to by an aberrant Delta3 activity, e.g. aberrant cell proliferation, degeneration or differentiation. In one embodiment, the disease or condition is a neurological disease, e.g., ACCPN. The method includes detecting, in a tissue of the subject, the presence or absence of a genetic lesion characterized by at least one of (i) a mutation of a gene encoding a Delta3 protein, e.g., as shown in SEQ ID Nos: 1, 3, 24, 26, 27, 29, 31, 33, 35, 37, 39, 41, 43 or 45, or the nucleotide sequence of the cDNA of a clone deposited with the ATCC® as Accession Number 98348, or a homolog thereof; or (ii) the mis-expression of a Delta3 gene. In one embodiments, detecting the genetic lesion includes ascertaining the existence of at least one of the following: a deletion of one or more nucleotides from a Delta3 gene; an addition of one or more nucleotides to the gene, a substitution of one or more nucleotides of the gene, a gross chromosomal rearrangement of the gene; an alteration in the level of a messenger RNA transcript of the gene; the presence of a non-wild type splicing pattern of a messenger RNA transcript of the gene; and/or a non-wild type level of the protein.

In a preferred embodiment, the invention provides a method for determining whether a subject has or is at risk of developing a disease or condition associated with a specific Delta3 allele, comprising determining the identity of a Delta3 allele in the subject. In an even more preferred embodiment, the disease or condition is a neurological disease, e.g., ACCPN. In another preferred embodiment, the disease is a vascular disorder. In another preferred embodiment, the disease is a neoplastic disorder. In another preferred embodiment the disease is a hematologic disorder. In another preferred embodiment the disease is an immunodeficiency disorder.

For example, detecting the genetic lesion or determining the identity of a Delta allele, e.g., a Delta3 allele, can include: (i) providing a probe/primer comprised of an oligonucleotide which hybridizes to a sense or antisense sequence of a Delta3 gene or naturally-occurring mutants thereof, or 5' or 3' flanking sequences naturally associated with the Delta3 gene; (ii) contacting the probe/primer with an appropriate nucleic acid containing sample; and (iii) detecting, by hybridization of the probe/primer to the nucleic acid, the presence or absence of the genetic lesion, e.g., by utilizing the probe/primer to determine the nucleotide sequence of the Delta3 gene and, optionally, of the flanking nucleic acid sequences. For instance, the primer can be employed in a polymerase chain reaction (PCR) or in a ligation chain reaction (LCR).

In another diagnostic method of the invention, at least a portion of a Delta3 gene of a subject is sequenced and the nucleotide sequence is compared to that of a wild-type Delta3 gene, to determine the presence of a genetic lesion. Another preferred diagnostic method of the invention is single strand conformation polymorphism (SSCP) which detects differences in electrophoretic mobility between mutant and wild-type nucleic acids.

In alternate embodiments, the diagnostic methods comprise determining the level of a Delta3 protein in an immunoassay using an antibody which is specifically immunoreactive with a wildtype or mutant Delta3 protein.

In another aspect, the present invention provides methods for detecting the presence of the activity or expression of a polypeptide of the invention in a biological sample by contacting the biological sample with an agent capable of detecting an indicator of activity such that the presence of activity is detected in the biological sample.

The present invention also provides diagnostic assays for identifying the presence or absence of a genetic lesion or mutation characterized by at least one of: (i) aberrant modification or mutation of a gene encoding a polypeptide of the invention, (ii) mis-regulation of a gene encoding a polypeptide of the invention, and (iii) aberrant post-translational modification of a polypeptide of the invention wherein a wild-type form of the gene encodes a polypeptide having the activity of the polypeptide of the invention.

Other features and advantages of the invention will be apparent from the following detailed description and claims.

FTHMA-070 and Tango85

The present invention is based, at least in part, on the discovery of a gene encoding FTHMA-070, a protein having homology to tumor necrosis factor (TNF) receptor and on the discovery of a gene encoding T85 (also referred to as FMHB-SD4 or FMHB-6D4).

The FTHMA-070 cDNA described below (SEQ ID NO:53) has a 1203 nucleotide open reading frame (nucleotides 73-1275 of SEQ ID NO:53; SEQ ID NO:55) which encodes a 403 amino acid protein (SEQ ID NO:54). This protein includes a predicted signal sequence of about 21 amino acids (from amino acid 1 to about amino acid 21 of SEQ ID NO:54) and a predicted mature protein of about 382 amino acids (from about amino acid 22 to amino acid 403 of SEQ ID NO:54; SEQ ID NO:56).

The T85 cDNA described below (SEQ ID NO:57) has a 2259 nucleotide open reading frame (nucleotides 958-3216 of SEQ ID NO:57; SEQ ID NO:59) which encodes a 753 amino acid protein (SEQ ID NO:58). This protein includes a predicted signal sequence of about 20 amino acids (from amino acid 1 to about amino acid 20 of SEQ ID NO:58) and a predicted mature protein of about 733 amino acids (from about amino acid 21 to amino acid 753 of SEQ ID NO:58; SEQ ID NO:60).

The nucleic acid and polypeptide molecules of the present invention are useful as modulating agents in regulating a variety of cellular processes. Accordingly, in one aspect, this invention provides isolated nucleic acid molecules encoding FTHMA-070 proteins or biologically active portions thereof, as well as nucleic acid fragments suitable as primers or hybridization probes for the detection of FTHMA-070-encoding nucleic acids. In another aspect, this invention provides isolated nucleic acid molecules encoding T85 proteins or biologically active portions thereof, as well as nucleic acid fragments suitable as primers or hybridization probes for the detection of T85-encoding nucleic acids.

The invention features a nucleic acid molecule which is at least 45% (or 55%, 65%, 75%, 85%, 95%, or 98%) identical to the nucleotide sequence shown in SEQ ID NO:53, or SEQ ID NO:55, or a complement thereof. The invention features a nucleic acid molecule which includes a fragment of at least 300 (325, 350, 375, 400, 425, 450, 500, 550, 600, 650, 700, 800, 900, 1000, or 1290) nucleotides of the nucleotide sequence shown in SEQ ID NO:53, or SEQ ID NO:55, or a complement thereof.

The invention also features a nucleic acid molecule which includes a nucleotide sequence encoding a protein having an amino acid sequence that is at least 45% (or 55%, 65%, 75%, 85%, 95%, or 98%) identical to the amino acid sequence of SEQ ID NO:54, SEQ ID NO:56. In a preferred embodiment, a FTHMA-070 nucleic acid molecule has the nucleotide sequence shown SEQ ID NO:53, or SEQ ID NO:55.

Also within the invention is a nucleic acid molecule which encodes a fragment of a polypeptide having the amino acid sequence of SEQ ID NO:54 or SEQ ID NO:56, the fragment including at least 15 (25, 30, 50, 100, 150, 300, or 400) contiguous amino acids of SEQ ID NO:54 or SEQ ID NO:56.

The invention includes a nucleic acid molecule which encodes a naturally occurring allelic variant of a polypeptide comprising the amino acid sequence of SEQ ID NO:54 or SEQ ID NO:56, wherein the nucleic acid molecule hybridizes to a nucleic acid molecule comprising SEQ ID NO:53 or SEQ ID NO:55 under stringent conditions.

Also within the invention are: an isolated FTHMA-070 protein having an amino acid sequence that is at least about 65%, preferably 75%, 85%, 95%, or 98% identical to the amino acid sequence of SEQ ID NO:56 (mature human FTHMA-070) or the amino acid sequence of SEQ ID NO:54 (immature human FTHMA-070).

Also within the invention are: an isolated FTHMA-070 protein which is encoded by a nucleic acid molecule having a nucleotide sequence that is at least about 65%, preferably 75%, 85%, or 95% identical to SEQ ID NO:55; and an isolated FTHMA-070 protein which is encoded by a nucleic acid molecule having a nucleotide sequence which hybridizes under stringent hybridization conditions to a nucleic acid molecule having the nucleotide sequence of SEQ ID NO:55.

Also within the invention is a polypeptide which is a naturally occurring allelic variant of a polypeptide that includes the amino acid sequence of SEQ ID NO:54 or SEQ ID NO:56, wherein the polypeptide is encoded by a nucleic acid molecule which hybridizes to a nucleic acid molecule comprising SEQ ID NO:53 or SEQ ID NO:55 under stringent conditions.

Another embodiment of the invention features FTHMA-070 nucleic acid molecules which specifically detect FTHMA-070 nucleic acid molecules. For example, in one embodiment, a FTHMA-070 nucleic acid molecule hybridizes under stringent conditions to a nucleic acid molecule comprising the nucleotide sequence of SEQ ID NO:53, SEQ ID NO:55, or a complement thereof. In another embodiment, the FTHMA-070 nucleic acid molecule is at least 300 (325, 350, 375, 400, 425, 450, 500, 550, 600, 650, 700, 800, 900, 1000, or 1200) nucleotides in length and hybridizes under stringent conditions to a nucleic acid molecule comprising the nucleotide sequence shown in SEQ ID NO:53 or SEQ ID NO:55, or a complement thereof. In another embodiment, the invention provides an isolated nucleic acid molecule which is antisense to the coding strand of a FTHMA-070 nucleic acid.

Another aspect of the invention provides a vector, e.g., a recombinant expression vector, comprising a FTHMA-070 nucleic acid molecule of the invention. In another embodiment the invention provides a host cell containing such a vector. The invention also provides a method for producing FTHAM-070 protein by culturing, in a suitable medium, a host cell of the invention containing a recombinant expression vector such that a FTHMA-070 protein is produced.

Another aspect of this invention features isolated or recombinant FTHMA-070 proteins and polypeptides. Preferred FTHMA-070 proteins and polypeptides possess at least one biological activity possessed by naturally occurring human FTHMA-070, e.g., the ability to form protein:protein interactions with other proteins.

The FTHMA-070 proteins of the present invention, or biologically active portions thereof, can be operatively linked to a non-FTHMA-070 polypeptide (e.g., heterologous amino acid sequences) to form FTHMA-070 fusion proteins. The invention further features antibodies that specifically bind FTHMA-070 proteins, such as monoclonal or polyclonal antibodies. In addition, the FTHMA-070 proteins or biologically active portions thereof can be incorporated into pharmaceutical compositions, which optionally include pharmaceutically acceptable carriers.

In another aspect, the present invention provides a method for detecting the presence of FTHMA-070 activity or expression in a biological sample by contacting the biological sample with an agent capable of detecting an indicator of FTHMA-070 activity such that the presence of FTHMA-070 activity is detected in the biological sample.

In another aspect, the invention provides a method for modulating FTHMA-070 activity comprising contacting a cell with an agent that modulates (inhibits or stimulates) FTHMA-070 activity or expression such that FTHMA-070 activity or expression in the cell is modulated. In one embodiment, the agent is an antibody that specifically binds to FTHMA-070 protein. In another embodiment, the agent modulates expression of FTHMA-070 by modulating transcription of a FTHMA-070 gene, splicing of a FTHMA-070 mRNA, or translation of a FTHMA-070 mRNA. In yet another embodiment, the agent is a nucleic acid molecule having a nucleotide sequence that is antisense to the coding strand of the FTHMA-070 mRNA or the FTHMA-070 gene.

In one embodiment, the methods of the present invention are used to treat a subject having a disorder characterized by aberrant FTHMA-070 protein or nucleic acid expression or activity by administering an agent which is a FTHMA-070 modulator to the subject. In one embodiment, the FTHMA-070 modulator is a FTHMA-070 protein. In another embodiment the FTHMA-070 modulator is a FTHMA-070 nucleic acid molecule. In other embodiments, the FTHMA-070 modulator is a peptide, peptidomimetic, or other small molecule.

The present invention also provides a diagnostic assay for identifying the presence or absence of a genetic lesion or mutation characterized by at least one of: (i) aberrant modification or mutation of a gene encoding a FTHMA-070 protein; (ii) mis-regulation of a gene encoding a FTHMA-070 protein; and (iii) aberrant post-translational modification of a FTHMA-070 protein, wherein a wild-type form of the gene encodes a protein with a FTHMA-070 activity.

In another aspect, the invention provides a method for identifying a compound that binds to or modulates the activity of a FTHMA-070 protein. In general, such methods entail measuring a biological activity of a FTHMA-070 protein in the presence and absence of a test compound and identifying those compounds which alter the activity of the FTHMA-070 protein.

The invention also features methods for identifying a compound which modulates the expression of FTHMA-070 by measuring the expression of FTHMA-070 in the presence and absence of a compound.

The invention features a nucleic acid molecule which is at least 45% (or 55%, 65%, 75%, 85%, 95%, or 98%) identical to the nucleotide sequence shown in SEQ ID NO:57, or SEQ ID NO:59, or a complement thereof. The invention features a nucleic acid molecule which includes a fragment of at least 300 (325, 350, 375, 400, 425, 450, 500, 550, 600, 650, 700, 800, 900, 1000, or 1290) nucleotides of the nucleotide sequence shown in SEQ ID NO:57, or SEQ ID NO:59, or a complement thereof.

The invention also features a nucleic acid molecule which includes a nucleotide sequence encoding a protein having an amino acid sequence that is at least 45% (or 55%, 65%, 75%, 85%, 95%, or 98%) identical to the amino acid sequence of SEQ ID NO:58 or SEQ ID NO:60. In a preferred embodiment, a T85 nucleic acid molecule has the nucleotide sequence shown SEQ ID NO:57, or SEQ ID NO:59.

Also within the invention is a nucleic acid molecule which encodes a fragment of a polypeptide having the amino acid sequence of SEQ ID NO:58 or SEQ ID NO:60, the fragment including at least 15 (25, 30, 50, 100, 150, 300, or 400) contiguous amino acids of SEQ ID NO:58 or SEQ ID NO:60.

The invention includes a nucleic acid molecule which encodes a naturally occurring allelic variant of a polypeptide comprising the amino acid sequence of SEQ ID NO:58 or SEQ ID NO:60, wherein the nucleic acid molecule hybridizes to a nucleic acid molecule comprising SEQ ID NO:57 or SEQ ID NO:59 under stringent conditions.

Also within the invention are: an isolated T85 protein having an amino acid sequence that is at least about 65%, preferably 75%, 85%, 95%, or 98% identical to the amino acid sequence of SEQ ID NO:60 (mature human T85) or the amino acid sequence of SEQ ID NO:58 (immature human T85); and an isolated T85 protein having an amino acid sequence that is at least about 85%, 95%, or 98% identical to one or more of the fibronectin type III domains and Ig superfamily domains described herein.

Also within the invention are: an isolated T85 protein which is encoded by a nucleic acid molecule having a nucleotide sequence that is at least about 65%, preferably 75%, 85%, or 95% identical to SEQ ID NO:59; an isolated T85 protein which is encoded by a nucleic acid molecule having a nucleotide sequence at least about 65% preferably 75%, 85%, or 95% identical a fibronectin III or Ig superfamily domain encoding portion of SEQ ID NO:57; and an isolated T85 protein which is encoded by a nucleic acid molecule having a nucleotide sequence which hybridizes under stringent hybridization conditions to a nucleic acid molecule having the nucleotide sequence of SEQ ID NO:59.

Also within the invention is a polypeptide which is a naturally occurring allelic variant of a polypeptide that includes the amino acid sequence of SEQ ID NO:58 or SEQ ID NO:60, wherein the polypeptide is encoded by a nucleic acid molecule which hybridizes to a nucleic acid molecule comprising SEQ ID NO:57 or SEQ ID NO:59 under stringent conditions.

Another embodiment of the invention features T85 nucleic acid molecules which specifically detect T85 nucleic acid molecules. For example, in one embodiment, a T85 nucleic acid molecule hybridizes under stringent conditions to a nucleic acid molecule comprising the nucleotide sequence of SEQ ID NO:57 or SEQ ID NO:59, or a complement thereof. In another embodiment, the T85 nucleic acid molecule is at least 300 (325, 350, 375, 400, 425, 450, 500, 550, 600, 650, 700, 800, 900, 1000, or 1290) nucleotides in length and hybridizes under stringent conditions to a nucleic acid molecule comprising the nucleotide sequence shown in SEQ ID NO:57 or SEQ ID NO:59, or a complement thereof. In a preferred embodiment, an isolated T85 nucleic acid molecule comprises a nucleotide sequence of SEQ ID NO:57 which encodes a fibronectin type III domain, or a complement thereof. In another preferred embodiment, an isolated T85 nucleic acid molecule comprises a nucleotide of SEQ ID NO:57 which encodes an Ig superfamily domain, or a complement thereof. In another embodiment, the invention provides an isolated nucleic acid molecule which is antisense to the coding strand of a T85 nucleic acid.

Another aspect of the invention provides a vector, e.g., a recombinant expression vector, comprising a T85 nucleic acid molecule of the invention. In another embodiment the invention provides a host cell containing such a vector. The invention also provides a method for producing T85 protein by culturing, in a suitable medium, a host cell of the invention containing a recombinant expression vector such that a T85 protein is produced.

Another aspect of this invention features isolated or recombinant T85 proteins and polypeptides. Preferred T85 proteins and polypeptides possess at least one biological activity possessed by naturally occurring human T85, e.g., the ability to form protein:protein interactions with other proteins.

The T85 proteins of the present invention, or biologically active portions thereof, can be operatively linked to a non-T85 polypeptide (e.g., heterologous amino acid sequences) to form T85 fusion proteins. The invention further features antibodies that specifically bind T85 proteins, such as monoclonal or polyclonal antibodies. In addition, the T85 proteins or biologically active portions thereof can be incorporated into pharmaceutical compositions, which optionally include pharmaceutically acceptable carriers.

In another aspect, the present invention provides a method for detecting the presence of T85 activity or expression in a biological sample by contacting the biological sample with an agent capable of detecting an indicator of T85 activity such that the presence of T85 activity is detected in the biological sample.

In another aspect, the invention provides a method for modulating T85 activity comprising contacting a cell with an agent that modulates (inhibits or stimulates) T85 activity or expression such that T85 activity or expression in the cell is modulated. In one embodiment, the agent is an antibody that specifically binds to T85 protein. In another embodiment, the agent modulates expression of T85 by modulating transcription of a T85 gene, splicing of a T85 mRNA, or translation of a T85 mRNA. In yet another embodiment, the agent is a nucleic acid molecule having a nucleotide sequence that is antisense to the coding strand of the T85 mRNA or the T85 gene.

In one embodiment, the methods of the present invention are used to treat a subject having a disorder characterized by aberrant T85 protein or nucleic acid expression or activity by administering an agent which is a T85 modulator to the subject. In one embodiment, the T85 modulator is a T85 protein. In another embodiment the T85 modulator is a T85 nucleic acid molecule. In other embodiments, the T85 modulator is a peptide, peptidomimetic, or other small molecule.

The present invention also provides a diagnostic assay for identifying the presence or absence of a genetic lesion or mutation characterized by at least one of: (i) aberrant modification or mutation of a gene encoding a T85 protein; (ii) mis-regulation of a gene encoding a T85 protein; and (iii) aberrant post-translational modification of a T85 protein, wherein a wild-type form of the gene encodes a protein with a T85 activity.

In another aspect, the invention provides a method for identifying a compound that binds to or modulates the activity of a T85 protein. In general, such methods entail measuring a biological activity of a T85 protein in the presence and absence of a test compound and identifying those compounds which alter the activity of the T85 protein.

The invention also features methods for identifying a compound which modulates the expression of T85 by measuring the expression of T85 in the presence and absence of a compound.

Tango 77

The present invention is based, at least in part, on the discovery of a gene encoding Tango-77, a secreted protein that is predicted to be a member of the cytokine superfamily. The Tango-77 cDNA described below (SEQ ID NO:71) has three possible open reading frames. The first potential open reading frame encompasses 534 nucleotides extending from nucleotide 356 to nucleotide 889 of SEQ ID NO:71 (SEQ ID NO:73) and encodes a 178 amino acid protein (SEQ ID NO:72). This protein may include a predicted signal sequence of about 63 amino acids (from about amino acid 1 to about amino acid 63 of SEQ ID NO:72 (SEQ ID NO:74) and a predicted mature protein of about 115 amino acids (from about amino acid 64 to amino acid 178 of SEQ ID NO:72 (SEQ ID NO:75)).

The second potential open reading frame encompasses 498 nucleotides extending from nucleotide 389 to nucleotide 889 of SEQ ID NO:71 (SEQ ID NO:76) and encodes a 167 amino acid protein (SEQ ID NO:77). This protein may include a predicted signal sequence of about 52 amino acids (from about amino acid 1 to about amino acid 52 of SEQ ID NO:77 (SEQ ID NO:78)) and a predicted mature protein of about 115 amino acids (from about amino acid 52 to amino acid 167 of SEQ ID NO:77 (SEQ ID NO:79)).

The third potential open reading frame encompasses 408 nucleotides extending from nucleotide 481 to nucleotide 889 of SEQ ID NO:71 (SEQ ID NO:80) and encodes a 136 amino acid protein (SEQ ID NO:81). This protein includes a predicted signal sequence of about 21 amino acids (from about amino acid 1 to about amino acid 21 of SEQ ID NO:81 (SEQ ID NO:82)) and a predicted mature protein of about 115 amino acids (from about amino acid 22 to amino acid 136 of SEQ ID NO:81 (SEQ ID NO:83)).

As used herein, the terms "Tango-77", "Tango-77 protein", "Tango-77 polypeptide" and the like, can refer and polypeptide produced by the cDNA of SEQ ID NO:71 including any and all of the Tango-77 gene products described above.

Tango-77 is expected to inhibit inflammation and play a functional role similar to that of secreted IL-1ra. For example, it is expected that Tango-77 may bind to the IL-1 receptor, thus blocking receptor activation by inhibiting the binding of IL-1a and IL-11 to the receptor. Alternatively, Tango-77 may inhibit inflammation through another pathway, for example, by binding to a novel receptor. Accordingly, Tango-77 may be useful as a modulating agent in regulating a variety of cellular processes including acute and chronic inflammation, e.g., asthma, chronic myelogenous leukemia, rheumatoid arthritis, psoriasis and inflammatory bowel disease.

In one aspect, the invention provides isolated nucleic acid molecules encoding Tango-77 or biologically active portions thereof, as well as nucleic acid fragments suitable as primers or hybridization probes for the detection of Tango-77.

The invention encompasses methods of diagnosing and treating patients who are suffering from a disorder associated with an abnormal level (undesirably high or undesirably low) of inflammation, abnormal activity of the IL-1 receptor complex, or abnormal activity of IL-1, by administering a compound that modulates the expression of Tango-77 (at the DNA, mRNA or protein level, e.g., by altering mRNA splicing) or by altering the activity of Tango-77. Examples of such compounds include small molecules, antisense nucleic acid molecules, ribozymes, and polypeptides.

The invention features a nucleic acid molecule which is at least 45% (e.g., 55%, 65%, 75%, 85%, 95%, or 98%) identical to the nucleotide sequence shown in SEQ ID NO:71, SEQ ID NO:73, SEQ ID NO:76, SEQ ID NO:80, the nucleotide sequence of the cDNA insert of the plasmid deposited with ATCC as Accession Number (the "cDNA of ATCC 98807"), or a complement thereof.

The invention features a nucleic acid molecule which includes a fragment of at least 100 (e.g., 250, 325, 350, 375, 400, 425, 450, 500, 550, 600, 650, 700, 800, 900, or 989) nucleotides of the nucleotide sequence shown in SEQ ID NO:71, SEQ ID NO:73, SEQ ID NO:76, SEQ ID NO:80, the nucleotide sequence of the cDNA ATCC 98807, or a complement thereof.

The invention also features a nucleic acid molecule which includes a nucleotide sequence encoding a protein having an amino acid sequence that is at least 45% (55%, 65%, 75%, 85%, 95%, or 98%) identical to the amino acid sequence of SEQ ID NO:72, SEQ ID NO:75, SEQ ID NO:77, SEQ ID NO:79, SEQ ID NO:81, SEQ ID NO:83, or the amino acid sequence encoded by the cDNA of ATCC 98807.

In a preferred embodiment, a Tango-77 nucleic acid molecule has the nucleotide sequence shown in SEQ ID NO:71, SEQ ID NO:73, SEQ ID NO:76, SEQ ID NO:80 or the nucleotide sequence of the cDNA of ATCC 98807.

Also within the invention is a nucleic acid molecule which encodes a fragment of a polypeptide having the amino acid sequence of SEQ ID NO:72, SEQ ID NO:74, SEQ ID NO:75, SEQ ID NO:77, SEQ ID NO:78, SEQ ID NO:79, SEQ ID NO:81, SEQ ID NO:82, SEQ ID NO:83, wherein the fragment includes at least 15 (e.g., 25, 30, 50, 100, 150, or 178) contiguous amino acids of SEQ ID NO:72, SEQ ID NO:74, SEQ ID NO:75, SEQ ID NO:77, SEQ ID NO:78, SEQ ID NO:79, SEQ ID NO:81, SEQ ID NO:82, SEQ ID NO:83, or the polypeptide encoded by the cDNA of ATCC Accession Number 98807.

The invention includes a nucleic acid molecule which encodes a naturally occurring allelic variant of a polypeptide comprising the amino acid sequence of SEQ ID NO:72, SEQ ID NO:74, SEQ ID NO:75, SEQ ID NO:77, SEQ ID NO:78, SEQ ID NO:79, SEQ ID NO:81, SEQ ID NO:82, SEQ ID NO:83, or an amino acid sequence encoded by the cDNA of ATCC Accession Number 98807, wherein the nucleic acid molecule hybridizes to a nucleic acid molecule comprising SEQ ID NO:71, SEQ ID NO:73, SEQ ID NO:76, SEQ ID NO:80, or a complement thereof under stringent conditions.

Also within the invention are: an isolated Tango-77 protein having an amino acid sequence that is at least about 45%, preferably 65%, 75%, 85%, 95%, or 98% identical to the amino acid sequence of SEQ ID NO:75, SEQ ID NO:79 or SEQ ID NO:83 (mature human Tango-77), or the amino acid sequence of SEQ ID NO:72, SEQ ID NO:77 or SEQ ID NO:81 (immature human Tango-77).

Also within the invention are: an isolated Tango-77 protein which is encoded by a nucleic acid molecule having a nucleotide sequence that is at least about 65%, preferably 75%, 85%, or 95% identical to SEQ ID NO:73, SEQ ID NO:76, SEQ ID NO:80 or the cDNA of ATCC 98807; and an isolated Tango-77 protein which is encoded by a nucleic acid molecule having a nucleotide sequence which hybridizes under stringent hybridization conditions to a nucleic acid molecule having the nucleotide sequence of SEQ ID NO:73, SEQ ID NO:76, SEQ ID NO:80, the non-coding strand of the cDNA of ATCC 98807, or the complement thereof.

Also within the invention is a polypeptide which is a naturally occurring allelic variant of a polypeptide that includes the amino acid sequence of SEQ ID NO:72, SEQ ID NO:74, SEQ ID NO:75, SEQ ID NO:77, SEQ ID NO:78, SEQ ID NO:79, SEQ ID NO:81, SEQ ID NO:82, SEQ ID NO:83, or an amino acid sequence encoded by the cDNA insert of the plasmid deposited with ATCC as Accession Number 98807, wherein the polypeptide is encoded by a nucleic acid molecule which hybridizes to a nucleic acid molecule comprising SEQ ID NO:71, SEQ ID NO:73, SEQ ID NO:76, SEQ ID NO:80 or the complement thereof under stringent conditions.

Another embodiment of the invention features Tango-77 nucleic acid molecules which specifically detect Tango-77 nucleic acid molecules relative to nucleic acid molecules encoding other members of the cytokine superfamily. For example, in one embodiment, a Tango-77 nucleic acid molecule hybridizes under stringent conditions to a nucleic acid molecule comprising the nucleotide sequence of SEQ ID NO:71, SEQ ID NO:73, SEQ ID NO:76, SEQ ID NO:80, the cDNA of ATCC 98807, or a complement thereof. In another embodiment, the Tango-77 nucleic acid molecule is at least 300 (325, 350, 375, 400, 425, 450, 500, 550, 600, 650, 700, 800, 900, or 989) nucleotides in length and hybridizes under stringent conditions to a nucleic acid molecule comprising the nucleotide sequence shown in SEQ ID NO:71, SEQ ID NO:73, SEQ ID NO:76, SEQ ID NO:80, the cDNA of ATCC 98807, or a complement thereof. In yet another embodiment, the invention provides an isolated nucleic acid molecule which is antisense to the coding strand of a Tango-77 nucleic acid.

Another aspect of the invention provides a vector, e.g., a recombinant expression vector, comprising a Tango-77 nucleic acid molecule of the invention. In another embodiment, the invention provides a host cell containing such a vector. The invention also provides a method for producing Tango-77 protein by culturing, in a suitable medium, a host cell of the invention containing a recombinant expression vector such that a Tango-77 protein is produced.

Another aspect of this invention features isolated or recombinant Tango-77 proteins and polypeptides. Preferred Tango-77 proteins and polypeptides possess at least one biological activity possessed by naturally occurring human Tango-77, e.g., (i) the ability to interact with proteins in the Tango-77 signalling pathway (ii) the ability to interact with a Tango-77 ligand or receptor; or (iii) the ability to interact with an intracellular target protein, (iv) the ability to interact with a protein involved in inflammation and (v) the ability to bind the IL-1 receptor. Other activities include the induction and suppression of polypeptide interleukins, cytokines and growth factors.

The Tango-77 proteins of the present invention, or biologically active portions thereof, can be operably linked to a non-Tango-77 polypeptide (e.g., heterologous amino acid sequences) to form Tango-77 fusion proteins. The invention further features antibodies that specifically bind Tango-77 proteins, such as monoclonal or polyclonal antibodies. In addition, the Tango-77 proteins or biologically active portions thereof can be incorporated into pharmaceutical compositions, which optionally include pharmaceutically acceptable carriers.

In another aspect, the present invention provides a method for detecting the presence of Tango-77 activity or expression in a biological sample by contacting the biological sample with an agent capable of detecting an indicator of Tango-77 activity or expression such that the presence of Tango-77 activity or expression is detected in the biological sample.

In another aspect, the invention provides a method for modulating Tango-77 activity comprising contacting a cell with an agent that modulates (inhibits or stimulates) Tango-77 activity or expression such that Tango-77 activity or expression in the cell is modulated. In one embodiment, the agent is an antibody that specifically binds to Tango-77 protein.

In another embodiment, the agent modulates expression of Tango-77 by modulating transcription of a Tango-77 gene, splicing of a Tango-77 mRNA, or translation of a Tango-77 mRNA. In yet another embodiment, the agent is a nucleic acid molecule having a nucleotide sequence that is antisense to the coding strand of the Tango-77 mRNA or the Tango-77 gene.

In one embodiment, the methods of the present invention are used to treat a subject having a disorder characterized by aberrant Tango-77 protein activity or nucleic acid expression by administering an agent which is a Tango-77 modulator to the subject. In one embodiment, the Tango-77 modulator is a Tango-77 protein. In another embodiment, the Tango-77 modulator is a Tango-77 nucleic acid molecule. In other embodiments, the Tango-77 modulator is a peptide, peptidomimetic, or other small molecule. In a preferred embodiment, the disorder characterized by aberrant Tango-77 protein or nucleic acid expression can include chronic and acute inflammation.

The present invention also provides a diagnostic assay for identifying the presence or absence of a genetic lesion or mutation characterized by at least one of: (i) aberrant modification or mutation of a gene encoding a Tango-77 protein; (ii) mis-regulation of a gene encoding a Tango-77 protein; and (iii) aberrant post-translational modification of a Tango-77 protein, wherein a wild-type form of the gene encodes a protein with a Tango-77 activity.

In another aspect, the invention provides a method for identifying a compound that binds to or modulates the activity of a Tango-77 protein. In general, such methods entail measuring a biological activity of a Tango-77 protein in the presence and absence of a test compound and identifying those compounds which alter the activity of the Tango-77 protein.

The invention also features methods for identifying a compound which modulates the expression of Tango-77 by measuring the expression of Tango-77 in the presence and absence of a compound.

SPOIL

The present invention is based, at least in part, on the discovery of novel nucleic acid molecules which encode a novel family of proteins having homology to IL-1 receptor antagonist (IL-1ra) molecules, referred to herein as SPOIL nucleic acid and protein molecules. The SPOIL molecules of the present invention are useful as modulating agents in regulating a variety of cellular processes. Accordingly, in one aspect, this invention provides isolated nucleic acid molecules encoding SPOIL proteins and biologically active portions thereof, as well as nucleic acid fragments suitable as primers or hybridization probes for the detection of SPOIL-encoding nucleic acids. In one embodiment, an isolated nucleic acid molecule of the present invention preferably encodes a SPOIL protein which includes an interleukin-1 (IL-1) signature domain.

In another embodiment, an isolated nucleic acid molecule of the present invention preferably encodes a SPOIL protein which includes a SPOIL signature motif. In another embodiment, an isolated nucleic acid molecule of the present invention preferably encodes a SPOIL protein which includes a SPOIL unique domain. In another embodiment, an isolated nucleic acid molecule of the present invention preferably encodes a SPOIL protein which includes a SPOIL C-terminal unique domain. In another embodiment, an isolated nucleic acid molecule of the present invention preferably encodes a SPOIL protein which includes a signal sequence and/or is secreted. In yet another embodiment, an isolated nucleic acid molecule of the present invention preferably encodes a SPOIL protein which lacks a signal sequence and/or is intracellular. In another embodiment, the nucleic acid molecule is a naturally occurring nucleotide sequence.

In another embodiment, a nucleic acid molecule of the invention has 65% identity with the nucleotide sequence shown in SEQ ID NO:89, SEQ ID NO:101, SEQ ID NO:104, SEQ ID NO: 112, the DNA insert of the plasmid deposited with ATCC as Accession Number 98883, the DNA insert of the plasmid deposited with ATCC as Accession Number 98984 or a complement thereof and, preferably, encodes a SPOIL protein. In yet another embodiment, the isolated nucleic acid molecule has 65% identity with the nucleotide sequence shown in SEQ ID NO:91, SEQ ID NO:103, SEQ ID NO: 106, SEQ ID NO:114, or a complement thereof and, preferably, encodes a SPOIL protein. In a preferred embodiment, an isolated nucleic acid molecule encodes the amino acid sequence of a mammalian protein, (e.g., a human or mouse SPOIL protein.)

In another embodiment, the isolated nucleic acid molecule includes a nucleotide sequence encoding a protein having an amino acid sequence sufficiently homologous to the amino acid sequence of SEQ ID NO:90; SEQ ID NO: 102, SEQ ID NO: 105, SEQ ID NO: 113, the amino acid sequence encoded by the DNA insert of the plasmid deposited with ATCC as Accession Number 98883, or the DNA insert of the plasmid deposited with ATCC as Accession Number 98984 and, preferably, encodes a SPOIL protein. In a preferred embodiment, the nucleic acid molecule has the nucleotide sequence shown in SEQ ID NO:91, SEQ ID NO:103, SEQ ID NO:106, or SEQ ID NO: 114. In another preferred embodiment, the nucleic acid molecule has the nucleotide sequence shown in SEQ ID NO:89, SEQ ID NO:101, SEQ ID NO:104, SEQ ID NO:112, the DNA insert of the plasmid deposited with ATCC as Accession Number 98883, or the DNA insert of the plasmid deposited with ATCC as Accession Number 98984.

Another embodiment of the invention features isolated nucleic acid molecules which hybridize under stringent conditions to a nucleic acid molecule consisting of nucleotides 135-428 or nucleotides 495-746 of SEQ ID NO:89. In yet another preferred embodiment, the isolated nucleic acid molecules hybridize under stringent conditions to a nucleic acid molecule consisting of nucleotides 1-280, 123-260, or nucleotides 390-1291 of SEQ ID NO:101. In yet another preferred embodiment, the isolated nucleic acid molecules hybridize under stringent conditions to a nucleic acid molecule consisting of nucleotides 1-371, 98-721, or nucleotides 481-1377 of SEQ ID NO: 104. In yet another preferred embodiment, the isolated nucleic acid molecules hybridize under stringent conditions to a nucleic acid molecule consisting of nucleotides 225-365, 96-575, or nucleotides 495-838 of SEQ ID NO:112. In another embodiment, the nucleic acid molecule is at least 300 nucleotides in length. In another embodiment, the nucleic acid molecule is at least 300 nucleotides in length and hybridizes under stringent conditions to a nucleic acid molecule comprising the nucleotide sequence shown in SEQ ID NO:89, SEQ ID NO: 101, SEQ ID NO: 104, SEQ ID NO:112, the DNA insert of the plasmid deposited with ATCC as Accession Number 98883, or the DNA insert of the plasmid deposited with ATCC as Accession Number 98984, or a complement thereof. In yet another embodiment, the nucleic acid molecule is at least 300 nucleotides in length and encodes a SPOIL protein or portion thereof, preferably a biologically active portion thereof.

In a preferred embodiment, an isolated nucleic acid molecule comprises nucleotides 135-428 of SEQ ID NO:89, or a complement thereof. In another embodiment, the nucleic acid molecule further comprises nucleotides 1-134 of SEQ ID NO:89. In yet another embodiment, the nucleic acid molecule further comprises nucleotides 429-746 of SEQ ID NO:89.

In another preferred embodiment, an isolated nucleic acid molecule comprises nucleotides 124-630 of SEQ ID NO:101, or a complement thereof. In another embodiment, the nucleic acid molecule further comprises nucleotides 1-123 of SEQ ID NO:101. In yet another embodiment, the nucleic acid molecule further comprises nucleotides 631-1291 of SEQ ID NO:101.

In another preferred embodiment, an isolated nucleic acid molecule comprises nucleotides 98-721 of SEQ ID NO: 104, or a complement thereof. In another embodiment, the nucleic acid molecule further comprises nucleotides 1-97 of SEQ ID NO: 104. In yet another embodiment, the nucleic acid molecule further comprises nucleotides 722-1377 of SEQ ID NO: 104.

In another preferred embodiment, an isolated nucleic acid molecule comprises nucleotides 96-575 of SEQ ID NO: 112, or a complement thereof. In another embodiment, the nucleic acid molecule further comprises nucleotides 1-95 of SEQ ID NO: 112. In yet another embodiment, the nucleic acid molecule further comprises nucleotides 576-838 of SEQ ID NO:112.

Another embodiment the invention provides an isolated nucleic acid molecule which is antisense to the coding strand of a SPOIL nucleic acid.

Another aspect of the invention provides a vector comprising a nucleic acid molecule of the invention, preferably a SPOIL nucleic acid molecule. In certain embodiments, the vector is a recombinant expression vector. In another embodiment, the invention provides a host cell containing a vector of the invention. The invention also provides a method for producing SPOIL protein by culturing in a suitable medium, a host cell of the invention containing a recombinant expression vector such that SPOIL protein is produced.

Another aspect of this invention features isolated or recombinant proteins and polypeptides, preferably SPOIL proteins or polypeptides. In one embodiment, an isolated protein, preferably a SPOIL protein, has a SPOIL signature motif. In another embodiment, an isolated protein, preferably a SPOIL protein, has an IL-1 signature domain. In another embodiment, an isolated protein, preferably a SPOIL protein, has a SPOIL unique domain. In another embodiment, an isolated protein, preferably a SPOIL protein, has a SPOIL C-terminal unique domain. In another embodiment, an isolated protein, preferably a SPOIL protein, has a combination of two or more of the above-stated domains and/or motifs. In yet another embodiment, an isolated protein, preferably a SPOIL protein, has a signal sequence and/or is secreted. In yet another embodiment, an isolated protein, preferably a SPOIL protein, lacks a signal sequence and/or is intracellular. In another embodiment, an isolated protein, preferably a SPOIL protein, has an amino acid sequence sufficiently homologous to the amino acid sequence of SEQ ID NO:90, SEQ ID NO:102, SEQ ID NO:105, SEQ ID NO:113, the amino acid sequence encoded by the DNA insert of the plasmid deposited with ATCC as Accession Number 98883, or the amino acid sequence encoded by the DNA insert of the plasmid deposited with ATCC as Accession Number 98984. This invention further features isolated proteins, preferably SPOIL proteins, having an amino acid sequence at least about 45% identical to a SPOIL unique domain amino acid sequence. This invention further features isolated proteins, preferably SPOIL proteins, having an amino acid sequence at least about 45% identical to a SPOIL C-terminal unique domain amino acid sequence.

In another embodiment, the invention features fragments of the protein having the amino acid sequence of SEQ ID NO:90, SEQ ID NO:102, SEQ ID NO:105, SEQ ID NO:113, the amino acid sequence encoded by the DNA insert of the plasmid deposited with ATCC as Accession Number 98883, or the amino acid sequence encoded by the DNA insert of the plasmid deposited with ATCC as Accession Number 98984, wherein the fragment comprises at least 15 contiguous amino acids of the amino acid sequence of SEQ ID NO:90, SEQ ID NO:102, SEQ ID NO:105, SEQ ID NO:113, the amino acid sequence encoded by the DNA insert of the plasmid deposited with ATCC as Accession Number 98883, or the amino acid sequence encoded by the DNA insert of the plasmid deposited with ATCC as Accession Number 98984. In a preferred embodiment, the protein has the amino acid sequence of SEQ ID NO:90, SEQ ID NO:102, SEQ ID NO:105, or SEQ ID NO:113.

Another embodiment of the invention features an isolated protein, preferably a SPOIL protein, having an amino acid sequence at least about 60% identical to the amino acid sequence of SEQ ID NO:90, SEQ ID NO:102, SEQ ID NO:105, or SEQ ID NO:113, the amino acid sequence encoded by the DNA insert of the plasmid deposited with ATCC as Accession Number 98883, or the amino acid sequence encoded by the DNA insert of the plasmid deposited with ATCC as Accession Number 98984. Another embodiment of the invention features an isolated protein, preferably a SPOIL protein, having an amino acid sequence at least about 85% identical to the amino acid sequence of SEQ ID NO:102 or the amino acid sequence encoded by the DNA insert of the plasmid deposited with ATCC as Accession Number 98984. Yet another embodiment of the invention features isolated proteins, preferably SPOIL proteins, which are encoded by nucleic acid molecules having a nucleotide sequence at least about 60% identical to a nucleotide sequence of SEQ ID NO:89, SEQ ID NO:91, SEQ ID NO:101, SEQ ID NO:103; SEQ ID NO:104, SEQ ID NO:106, SEQ ID NO:112, SEQ ID NO:114, the DNA insert of the plasmid deposited with ATCC as Accession Number 98883, or the DNA insert of the plasmid deposited with ATCC as Accession Number 98984, or a complement thereof.

This invention further features isolated proteins, preferably SPOIL proteins, which are encoded by nucleic acid molecules having a nucleotide sequence which hybridizes under stringent hybridization conditions to the complement of a nucleic acid molecule comprising the nucleotide sequence of SEQ ID NO:89, SEQ ID NO:91, SEQ ID NO:101, SEQ ID NO:103; SEQ ID NO:104, SEQ ID NO:106, SEQ ID NO:112, or SEQ ID NO:114.

The proteins of the present invention, preferably SPOIL proteins, or portions thereof (e.g., biologically active portions thereof), can be operatively linked to a non-SPOIL polypeptide to form fusion proteins, preferably SPOIL fusion proteins. The invention further features antibodies that specifically bind SPOIL proteins, such as monoclonal or polyclonal antibodies. In addition, the proteins of the invention or biologically active portions thereof can be incorporated into pharmaceutical compositions, which optionally include pharmaceutically acceptable carriers.

In another aspect, the present invention provides a method for detecting the presence of SPOIL activity or expression in a biological sample by contacting the biological sample with an agent capable of detecting an indicator of SPOIL activity such that the presence of SPOIL activity is detected in the biological sample.

In another aspect, the invention provides a method for modulating SPOIL activity comprising contacting a cell capable of expressing SPOIL with an agent that modulates SPOIL activity such that SPOIL activity in the cell is modulated. In one embodiment, the agent inhibits SPOIL activity. In another embodiment, the agent stimulates SPOIL activity. In one embodiment, the agent is an antibody that specifically binds to SPOIL protein. In another embodiment, the agent modulates expression of SPOIL by modulating transcription of a SPOIL gene or translation of a SPOIL mRNA. In yet another embodiment, the agent is a nucleic acid molecule having a nucleotide sequence that is antisense to the coding strand of the SPOIL mRNA or the SPOIL gene.

In another aspect, the invention provides a method for modulating IL-1 activity comprising contacting a cell capable of expressing and/or responding to IL-1 with an agent that modulates SPOIL activity such that IL-1 activity in the cell is modulated. In one embodiment, an agent inhibits or reduces IL-1 activity. Thus, in one embodiment, the SPOIL agent is a protein of the invention, preferably a SPOIL protein or a biologically active portion thereof which functions as an IL-1 receptor antagonist. In another embodiment, a SPOIL agent stimulates IL-1 activity. Thus, in another embodiment, the SPOIL agent is a protein of the invention, preferably a SPOIL protein, SPOIL variant, or biologically active portion thereof which functions as an IL-1 receptor agonist.

In another embodiment, the SPOIL agent is a protein of the invention, preferably a SPOIL protein or a biologically active portion thereof, which modulates an anti-inflammatory cytokine (e.g., soluble TNF-Receptor p55 (sTNFRp55), sTN-FRp75 and IL-1 receptor antagonist (IL-1Ra)). In yet another embodiment, the SPOIL agent is a protein of the invention, preferably a SPOIL protein, SPOIL variant, or biologically active portion thereof, which modulates a pro-inflammatory cytokine (e.g., tumor necrosis factor (TNF-a), interleukin-6 (IL-6) and interleukin-1b (IL-1b)).

In one embodiment, the methods of the present invention are used to treat a subject having a disorder characterized by aberrant SPOIL and/or IL-1 expression by administering an agent which is a SPOIL modulator to the subject. In one embodiment, the SPOIL agent is a SPOIL protein or SPOIL variant. In yet another embodiment, the SPOIL agent is a peptide, peptidomimetic, or other small molecule. In a preferred embodiment, the disorder characterized by aberrant SPOIL and/or IL-1 expression is a bone metabolism disorder, a proinflammatory disorder, or an immune disorder.

The present invention also provides a diagnostic assay for identifying the presence or absence of a genetic alteration characterized by at least one of (i) aberrant modification or mutation of a gene encoding a SPOIL protein; (ii) mis-regulation of said gene; and (iii) aberrant post-translational modification of a SPOIL protein, wherein a wild-type form of said gene encodes an protein with a SPOIL activity.

In another aspect, the invention provides a method for identifying a compound that binds to or modulates the activity of a SPOIL protein, by providing an indicator composition comprising an a SPOIL protein having SPOIL activity, contacting the indicator composition with a test compound, and determining the effect of the test compound on SPOIL activity in the indicator composition to identify a compound that modulates the activity of a SPOIL protein.

NEOKINE

The present invention is based, at least in part, on the discovery of nucleic acid molecules which encode a novel family of secreted proteins, referred to herein as the Neokine family of proteins ("NEOKINES" or "NEOKINE proteins") which are ligands for a previously-identified putative G protein-coupled receptor termed "RDC1" also referred to herein as the "NEOKINE receptor". The NEOKINE molecules of the present invention are useful as modulating agents in regulating a variety of cellular processes. Accordingly, in one aspect, this invention provides isolated nucleic acid molecules encoding NEOKINE proteins or biologically active portions thereof, as well as nucleic acid fragments suitable as primers or hybridization probes for the detection of NEOKINE-encoding nucleic acids.

In one embodiment, a NEOKINE nucleic acid molecule is 60% homologous to the nucleotide sequence shown in SEQ ID NO:115, SEQ ID NO:117, the nucleotide sequence of the DNA insert of the plasmid deposited with ATCC as Accession Number 98751, or complement thereof. In another embodiment, a NEOKINE nucleic acid molecule is 60% homologous to the nucleotide sequence shown in SEQ ID NO:118, SEQ ID NO:120, or a complement thereof. In yet another embodiment, a NEOKINE nucleic acid molecule is 60% homologous to the nucleotide sequence shown in SEQ ID NO:121 or SEQ ID NO:123. In yet another embodiment, a NEOKINE nucleic acid molecule is 60% homologous to the nucleotide sequence shown in SEQ ID NO:124. In a preferred embodiment, an isolated NEOKINE nucleic acid molecule has the nucleotide sequence shown SEQ ID NO:117, or a complement thereof.

In another embodiment, a NEOKINE nucleic acid molecule further comprises nucleotides 1-96 of SEQ ID NO:115. In another embodiment, a NEOKINE nucleic acid molecule further comprises nucleotides 394-1564 of SEQ ID NO:115. In another preferred embodiment, an isolated NEOKINE nucleic acid molecule has the nucleotide sequence shown in SEQ ID NO:115.

In another preferred embodiment, an isolated NEOKINE nucleic acid molecule has the nucleotide sequence shown SEQ ID NO:120, or a complement thereof. In another embodiment, a NEOKINE nucleic acid molecule further comprises nucleotides 1-211 of SEQ ID NO:118. In another embodiment, a NEOKINE nucleic acid molecule further comprises nucleotides 509-1656 of SEQ ID NO:118. In another preferred embodiment, an isolated NEOKINE nucleic acid molecule has the nucleotide sequence shown in SEQ ID NO:118.

In another preferred embodiment, an isolated NEOKINE nucleic acid molecule has the nucleotide sequence shown SEQ ID NO:123, or a complement thereof. In another embodiment, a NEOKINE nucleic acid molecule further comprises nucleotides 235-1372 of SEQ ID NO:121. In another preferred embodiment, an isolated NEOKINE nucleic acid molecule has the nucleotide sequence shown in SEQ ID NO:121.

In another preferred embodiment, an isolated NEOKINE nucleic acid molecule has the nucleotide sequence shown SEQ ID NO:136, or a complement thereof. In another embodiment, a NEOKINE nucleic acid molecule further comprises nucleotides 285-1458 of SEQ ID NO:124. In another preferred embodiment, an isolated NEOKINE nucleic acid molecule has the nucleotide sequence shown in SEQ ID NO:124.

In another preferred embodiment, an isolated NEOKINE nucleic acid molecule is of human origin and has the nucleotide sequence of the DNA insert of the plasmid deposited with ATCC as Accession Number 98751, or a complement thereof. In another embodiment, an isolated NEOKINE nucleic acid molecule is of rat origin. In another embodiment, an isolated NEOKINE nucleic acid molecule is of macaque origin.

In another embodiment, a NEOKINE nucleic acid molecule includes a nucleotide sequence encoding a protein having an amino acid sequence sufficiently homologous to the amino acid sequence of SEQ ID NO:116, SEQ ID NO:119, SEQ ID NO:122, or SEQ ID NO:125. In another preferred embodiment, a NEOKINE nucleic acid molecule includes a nucleotide sequence encoding a protein having an amino acid sequence at least 60% homologous to the amino acid sequence of SEQ ID NO:116. In yet another preferred embodiment, a NEOKINE nucleic acid molecule includes a nucleotide sequence encoding a protein having an amino acid sequence at least 60% homologous to the amino acid sequence of SEQ ID NO:119. In yet another preferred embodiment, a NEOKINE nucleic acid molecule includes a nucleotide sequence encoding a protein having an amino acid sequence at least 60% homologous to the amino acid sequence of SEQ ID NO:122. In yet another preferred embodiment, a NEOKINE nucleic acid molecule includes a nucleotide sequence encoding a protein having an amino acid sequence at least 60% homologous to the amino acid sequence of SEQ ID NO:125.

In another embodiment, an isolated nucleic acid molecule of the present invention encodes a NEOKINE protein which includes a NEOKINE CXC signature motif. In another embodiment, an isolated nucleic acid molecule of the present invention encodes a NEOKINE protein which includes a NEOKINE CXC signature motif and a signal sequence and is secreted. In yet another embodiment, a NEOKINE nucleic acid molecule encodes a NEOKINE protein and is a naturally occurring nucleotide sequence.

Another embodiment of the invention features NEOKINE nucleic acid molecules which specifically detect NEOKINE nucleic acid molecules relative to nucleic acid molecules encoding non-NEOKINE proteins. For example, in one embodiment, a NEOKINE nucleic acid molecule is at least 650 nucleotides in length and hybridizes under stringent conditions to a nucleic acid molecule comprising the nucleotide sequence shown in SEQ ID NO:115, SEQ ID NO:118, SEQ ID NO:121, or SEQ ID NO:124, or a complement thereof.

Another embodiment of the invention provides an isolated nucleic acid molecule which is antisense to the coding strand of a NEOKINE nucleic acid.

Another aspect of the invention provides a vector comprising a NEOKINE nucleic acid molecule. In certain embodiments, the vector is a recombinant expression vector. In another embodiment, the invention provides a host cell containing a vector of the invention. The invention also provides a method for producing a NEOKINE protein by culturing in a suitable medium, a host cell of the invention containing a recombinant expression vector such that a NEOKINE protein is produced.

Another aspect of this invention features isolated or recombinant NEOKINE proteins and polypeptides. In one embodiment, an isolated NEOKINE protein includes a NEOKINE CXC signature motif and is secreted. In another embodiment, an isolated NEOKINE protein includes a NEOKINE CXC signature motif and a signal sequence, and is secreted. In another embodiment, an isolated NEOKINE protein has an amino acid sequence sufficiently homologous to the amino acid sequence of SEQ ID NO:116, SEQ ID NO:119, SEQ ID NO:122, or SEQ ID NO:125. In a preferred embodiment, a NEOKINE protein has an amino acid sequence at least about 60% homologous to the amino acid sequence of SEQ ID NO:116. In another preferred embodiment, a NEOKINE protein has an amino acid sequence at least about 60% homologous to the amino acid sequence of SEQ ID NO:119. In another preferred embodiment, a NEOKINE protein has an amino acid sequence at least about 60% homologous to the amino acid sequence of SEQ ID NO:122. In another preferred embodiment, a NEOKINE protein has an amino acid sequence at least about 60% homologous to the amino acid sequence of SEQ ID NO:125. In another embodiment, a NEOKINE protein has the amino acid sequence of SEQ ID NO:116, SEQ ID NO:119, SEQ ID NO:122, or SEQ ID NO:125.

Another embodiment of the invention features an isolated NEOKINE protein which is encoded by a nucleic acid molecule having a nucleotide sequence at least about 60% homologous to a nucleotide sequence of SEQ ID NO:115, or a complement thereof. Another embodiment of the invention features an isolated NEOKINE protein which is encoded by a nucleic acid molecule having a nucleotide sequence at least about 60% homologous to a nucleotide sequence of SEQ ID NO:118, or a complement thereof. Another embodiment of the invention features an isolated NEOKINE protein which is encoded by a nucleic acid molecule having a nucleotide sequence at least about 60% homologous to a nucleotide sequence of SEQ ID NO:121, or a complement thereof. Another embodiment of the invention features an isolated NEOKINE protein which is encoded by a nucleic acid molecule having a nucleotide sequence at least about 60% homologous to a nucleotide sequence of SEQ ID NO:124, or a complement thereof. This invention further features an isolated NEOKINE protein which is encoded by a nucleic acid molecule having a nucleotide sequence which hybridizes under stringent hybridization conditions to a nucleic acid molecule comprising the nucleotide sequence of SEQ ID NO:115, SEQ ID NO:118, SEQ ID NO:121, SEQ ID NO:124, or a complement thereof.

The NEOKINE proteins of the present invention, or biologically active portions thereof, can be operatively linked to a non-NEOKINE polypeptide to form NEOKINE fusion proteins. The invention further features antibodies that specifically bind NEOKINE proteins, such as monoclonal or polyclonal antibodies. In addition, the NEOKINE proteins or biologically active portions thereof can be incorporated into pharmaceutical compositions, which optionally include pharmaceutically acceptable carriers.

In another aspect, the present invention provides a method for detecting NEOKINE expression in a biological sample by contacting the biological sample with an agent capable of detecting a NEOKINE nucleic acid molecule, protein or polypeptide such that the presence of a NEOKINE nucleic acid molecule, protein or polypeptide is detected in the biological sample.

In another aspect, the present invention provides a method for detecting the presence of NEOKINE activity in a biological sample by contacting the biological sample with an agent capable of detecting an indicator of NEOKINE activity such that the presence of NEOKINE activity is detected in the biological sample.

In another aspect, the invention provides a method for modulating NEOKINE activity comprising contacting the cell with an agent that modulates NEOKINE activity such that NEOKINE activity in the cell is modulated. In one embodiment, the agent inhibits NEOKINE activity. In another embodiment, the agent stimulates NEOKINE activity. In one embodiment, the agent is an antibody that specifically binds to a NEOKINE protein. In another embodiment, the agent modulates expression of NEOKINE by modulating transcription of a NEOKINE gene or translation of a NEOKINE mRNA. In yet another embodiment, the agent is a nucleic acid molecule having a nucleotide sequence that is antisense to the coding strand of a NEOKINE mRNA or a NEOKINE gene.

In one embodiment, the methods of the present invention are used to treat a subject having a disorder characterized by aberrant NEOKINE protein or nucleic acid expression or activity by administering an agent which is a NEOKINE modulator to the subject. In one embodiment, the NEOKINE modulator is a NEOKINE protein. In another embodiment the NEOKINE modulator is a NEOKINE nucleic acid molecule. In yet another embodiment, the NEOKINE modulator is a peptide, peptidomimetic, or other small molecule. In a preferred embodiment, the disorder characterized by aberrant NEOKINE protein or nucleic acid expression is a developmental, differentiative, proliferative disorder, an immunological disorder, or cell death.

The present invention also provides a diagnostic assay for identifying the presence or absence of a genetic alteration characterized by at least one of (i) aberrant modification or mutation of a gene encoding a NEOKINE protein; (ii) misregulation of said gene; and (iii) aberrant post-translational modification of a NEOKINE protein, wherein a wild-type form of said gene encodes an protein with a NEOKINE activity.

The present invention also provides methods for identifying compounds which modulate binding of NEOKINE to the NEOKINE receptor and methods for identifying compounds which modulate the activity of the NEOKINE receptor (e.g., cell-based as well as in vitro screening assays).

Tango 129

The present invention is based, at least in part, on the discovery of a gene encoding T129, a transmembrane protein that is predicted to be a member of the TNF receptor superfamily. The T129 cDNA described below (SEQ ID NO:137) has a 1290 nucleotide open reading frame (nucleotides 99-1388 of SEQ ID NO:137; SEQ ID NO:139) which encodes a 430 amino acid protein (SEQ ID NO:138). This protein includes a predicted signal sequence of about 22 amino acids (from amino acid 1 to about amino acid 22 of SEQ ID NO:138) and a predicted mature protein of about 408 amino acids (from about amino acid 23 to amino acid 430 of SEQ ID NO:138; SEQ ID NO:140). T129 protein possesses a Tumor Necrosis Factor Receptor/Nerve Growth Factor Receptor ("TNFR/NGFR") cysteine-rich region domain (amino acids 51-90; SEQ ID NO:142). T129 is predicted to have one transmembrane domain (TM) which extends from about amino acid 163 (extracellular end) to about amino acid 186 (cytoplasmic end) of SEQ ID NO:138.

The T129 molecules of the present invention are useful as modulating agents in regulating a variety of cellular processes. Accordingly, in one aspect, this invention provides isolated nucleic acid molecules encoding T129 proteins or biologically active portions thereof, as well as nucleic acid fragments suitable as primers or hybridization probes for the detection of T129-encoding nucleic acids.

The invention features a nucleic acid molecule which is at least 45% (or 55%, 65%, 75%, 85%, 95%, or 98%) identical to the nucleotide sequence shown in SEQ ID NO:137, or SEQ ID NO:139, or a complement thereof. The invention features a nucleic acid molecule which includes a fragment of at least 300 (325, 350, 375, 400, 425, 450, 500, 550, 600, 650, 700, 800, 900, 1000, or 1290) nucleotides of the nucleotide sequence shown in SEQ ID NO:137, or SEQ ID NO:139, or a complement thereof.

The invention also features a nucleic acid molecule which includes a nucleotide sequence encoding a protein having an amino acid sequence that is at least 45% (or 55%, 65%, 75%, 85%, 95%, or 98%) identical to the amino acid sequence of SEQ ID NO:138, SEQ ID NO:140. In a preferred embodiment, a T129 nucleic acid molecule has the nucleotide sequence shown SEQ ID NO: 137, or SEQ ID NO:139.

Also within the invention is a nucleic acid molecule which encodes a fragment of a polypeptide having the amino acid sequence of SEQ ID NO:138 or SEQ ID NO:140, the fragment including at least 15 (25, 30, 50, 100, 150, 300, or 400) contiguous amino acids of SEQ ID NO:138 or SEQ ID NO:140.

The invention includes a nucleic acid molecule which encodes a naturally occurring allelic variant of a polypeptide comprising the amino acid sequence of SEQ ID NO:138 or SEQ ID NO:140, wherein the nucleic acid molecule hybridizes to a nucleic acid molecule comprising SEQ ID NO:137 or SEQ ID NO:139 under stringent conditions.

Also within the invention are: an isolated T129 protein having an amino acid sequence that is at least about 65%, preferably 75%, 85%, 95%, or 98% identical to the amino acid sequence of SEQ ID NO:140 (mature human T129) or the amino acid sequence of SEQ ID NO:138 (immature human T129); and an isolated T129 protein having an amino acid sequence that is at least about 85%, 95%, or 98% identical to the TNFR/NGFR cysteine-rich domain of SEQ ID NO:138 (e.g., about amino acid residues 51 to 90 of SEQ ID NO:138; SEQ ID NO:142).

Also within the invention are: an isolated T129 protein which is encoded by a nucleic acid molecule having a nucleotide sequence that is at least about 65%, preferably 75%, 85%, or 95% identical to SEQ ID NO:139; an isolated T129 protein which is encoded by a nucleic acid molecule having a nucleotide sequence at least about 65% preferably 75%, 85%, or 95% identical the TNFR/NGFR cysteine-rich domain encoding portion of SEQ ID NO:137 (e.g., about nucleotides 248 to 368 of SEQ ID NO:137); and an isolated T129 protein which is encoded by a nucleic acid molecule having a nucleotide sequence which hybridizes under stringent hybridization conditions to a nucleic acid molecule having the nucleotide sequence of SEQ ID NO:139.

Also within the invention is a polypeptide which is a naturally occurring allelic variant of a polypeptide that includes the amino acid sequence of SEQ ID NO:138 or SEQ ID NO:140, wherein the polypeptide is encoded by a nucleic acid molecule which hybridizes to a nucleic acid molecule comprising SEQ ID NO:137 or SEQ ID NO:139 under stringent conditions.

Another embodiment of the invention features T129 nucleic acid molecules which specifically detect T129 nucleic acid molecules relative to nucleic acid molecules encoding other members of the TNF receptor superfamily. For example, in one embodiment, a T129 nucleic acid molecule hybridizes under stringent conditions to a nucleic acid molecule comprising the nucleotide sequence of SEQ ID NO:137, SEQ ID NO:139, or a complement thereof. In another embodiment, the T129 nucleic acid molecule is at least 300 (325, 350, 375, 400, 425, 450, 500, 550, 600, 650, 700, 800, 900, 1000, or 1290) nucleotides in length and hybridizes under stringent conditions to a nucleic acid molecule comprising the nucleotide sequence shown in SEQ ID NO:137, SEQ ID NO:139, or a complement thereof. In a preferred embodiment, an isolated T129 nucleic acid molecule comprises nucleotides 248 to 368 of SEQ ID NO:137, encoding the TNFR/NGFR cysteine-rich domain of T129, or a complement thereof. In another embodiment, the invention provides an isolated nucleic acid molecule which is antisense to the coding strand of a T129 nucleic acid.

Another aspect of the invention provides a vector, e.g., a recombinant expression vector, comprising a T129 nucleic acid molecule of the invention. In another embodiment the invention provides a host cell containing such a vector. The invention also provides a method for producing T129 protein by culturing, in a suitable medium, a host cell of the invention containing a recombinant expression vector such that a T129 protein is produced.

Another aspect of this invention features isolated or recombinant T129 proteins and polypeptides. Preferred T129 proteins and polypeptides possess at least one biological activity possessed by naturally occurring human T129, e.g., (1) the ability to form protein:protein interactions with proteins in the T129 signalling pathway; (2) the ability to bind T129 ligand; (3) the ability to bind to an intracellular target. Other activities include: (1) modulation of cellular proliferation and (2) modulation of cellular differentiation. In one embodiment, an isolated T129 protein has a TNFR/NGFR cysteine-rich domain and lacks both a transmembrane and a cytoplasmic domain. In another embodiment the T129 polypeptide lacks both a transmembrane domain and a cytoplasmic domain and is soluble under physiological conditions.

The T129 proteins of the present invention, or biologically active portions thereof, can be operatively linked to a non-T129 polypeptide (e.g., heterologous amino acid sequences) to form T129 fusion proteins. The invention further features antibodies that specifically bind T129 proteins, such as monoclonal or polyclonal antibodies. In addition, the T129 proteins or biologically active portions thereof can be incorporated into pharmaceutical compositions, which optionally include pharmaceutically acceptable carriers.

In another aspect, the present invention provides a method for detecting the presence of T129 activity or expression in a biological sample by contacting the biological sample with an agent capable of detecting an indicator of T129 activity such that the presence of T129 activity is detected in the biological sample.

In another aspect, the invention provides a method for modulating T129 activity comprising contacting a cell with an agent that modulates (inhibits or stimulates) T129 activity or expression such that T129 activity or expression in the cell is modulated. In one embodiment, the agent is an antibody that specifically binds to T129 protein. In another embodiment, the agent modulates expression of T129 by modulating transcription of a T129 gene, splicing of a T129 mRNA, or translation of a T129 mRNA. In yet another embodiment, the agent is a nucleic acid molecule having a nucleotide sequence that is antisense to the coding strand of the T129 mRNA or the T129 gene.

In one embodiment, the methods of the present invention are used to treat a subject having a disorder characterized by aberrant T129 protein or nucleic acid expression or activity by administering an agent which is a T129 modulator to the subject. In one embodiment, the T129 modulator is a T129 protein. In another embodiment the T129 modulator is a T129 nucleic acid molecule. In other embodiments, the T129 modulator is a peptide, peptidomimetic, or other small molecule. In a preferred embodiment, the disorder characterized by aberrant T129 protein or nucleic acid expression is a proliferative or differentiative disorder, particularly of the immune system. The present invention also provides a diagnostic assay for identifying the presence or absence of a genetic lesion or mutation characterized by at least one of: (i) aberrant modification or mutation of a gene encoding a T129 protein; (ii) mis-regulation of a gene encoding a T129 protein; and (iii) aberrant post-translational modification of a T129 protein, wherein a wild-type form of the gene encodes a protein with a T129 activity.

In another aspect, the invention provides a method for identifying a compound that binds to or modulates the activity of a T129 protein. In general, such methods entail measuring a biological activity of a T129 protein in the presence and absence of a test compound and identifying those compounds which alter the activity of the T129 protein.

The invention also features methods for identifying a compound which modulates the expression of T129 by measuring the expression of T129 in the presence and absence of a compound.

A259 (Integrin Alpha Subunit)

This invention provides novel human and murine nucleic acid molecules which encode proteins referred to herein as A259 proteins, which are novel integrin α subunits. These proteins, fragments, derivatives, and variants thereof are collectively referred to herein as "polypeptides of the invention" or "proteins of the invention". Nucleic acid molecules encoding the polypeptides or proteins of the invention are collectively referred to as "nucleic acids of the invention".

The A259 proteins are homologous to the α subunits of the integrin family, and in particular, to the α10 and α1 subunits of the integrin family.

The nucleic acids and polypeptides of the present invention are useful as modulating agents in regulating a variety of cellular processes. Accordingly, in one aspect, this invention provides isolated nucleic acid molecules encoding a polypeptide of the invention or a biologically active portion thereof. The present invention also provides nucleic acid molecules which are suitable for use as primers or hybridization probes for the detection of nucleic acids encoding a polypeptide of the invention.

The invention features nucleic acid molecules which are at least 47% (or 50%, 55%, 60%, 65%, 70%, 75%, 80%, 85%, 90%, 95%, or 98%) identical to the nucleotide sequence of SEQ ID NO:145, SEQ ID NO:163, the nucleotide sequence of the cDNA insert of a clone deposited with ATCC as Accession Number 207190 or 207191, or a complement thereof.

The invention features nucleic acid molecules which are at least 56% (or 57%, 58%, 59%, 60%, 65%, 70%, 75%, 80%, 85%, 90%, 95%, or 98%) identical to the nucleotide sequence of SEQ ID NO:146, SEQ ID NO:164, the nucleotide sequence of the cDNA insert of a clone deposited with ATCC as Accession Number 207190 or 207191, or a complement thereof.

The invention features nucleic acid molecules which include a fragment of at least 390 (400, 500, 600, 800, 1000, 1250, 1500, 1750, 2000, 2250, 2500, 2750, 3000, 3250, 3500, 3750, 4000, 4250, 4500, 4750, 5000, 5025, or 5042) nucleotides of the nucleotide sequence of SEQ ID NO:145, SEQ ID NO:163, the nucleotide sequence of the cDNA of ATCC Accession Number 207190 or 207191, or a complement thereof.

The invention also features nucleic acid molecules which include a nucleotide sequence encoding a protein having an amino acid sequence that is at least 44% (or 45%, 50%, 55%, 60%, 65%, 75%, 85%, 95%, or 98%) identical to the amino acid sequence of SEQ ID NO:147, SEQ ID NO:165, the amino acid sequence encoded by the cDNA of ATCC Accession Number 207190 or 207191, or a complement thereof.

In preferred embodiments, the nucleic acid molecules have the nucleotide sequence of SEQ ID NO:145, 146, 163, 164, or the nucleotide sequence of the cDNA of ATCC Accession Number 207190 or 207191.

Also within the invention are nucleic acid molecules which encode a fragment of a polypeptide having the amino acid sequence of SEQ ID NO:147, SEQ ID NO:165, or a fragment including at least 15 (25, 30, 50, 75, 100, 150, 200, 250, 300, 350, 400, 450, 500, 550, 600, 650, 700, 750, 800, 850, 900, 950, 1000, 1050, 1100, 1150, 1170, 1180, or 1188) contiguous amino acids of SEQ ID NO:147, SEQ ID NO:165, or the amino acid sequence encoded by the cDNA of ATCC Accession Number 207190 or 207191.

The invention includes nucleic acid molecules which encode a naturally occurring allelic variant of a polypeptide comprising the amino acid sequence of SEQ ID NO:147, SEQ ID NO:165, or the amino acid sequence encoded by the cDNA of ATCC Accession Number 207190 or 207191, wherein the nucleic acid molecule hybridizes to a nucleic acid molecule consisting of a nucleic acid sequence encoding SEQ ID NO:147, SEQ ID NO:165, the amino acid sequence encoded by the cDNA of ATCC Accession Number 207190 or 207191, or a complement thereof under stringent conditions.

Also within the invention are isolated polypeptides or proteins having an amino acid sequence that is at least about 44%, preferably 45%, 50%, 55%, 60%, 65%, 75%, 85%, 95%, or 98% identical to the amino acid sequence of SEQ ID NO:147, SEQ ID NO:165, or the amino acid sequence encoded by the cDNA of ATCC Accession Number 207190 or 207191.

Also within the invention are isolated polypeptides or proteins which are encoded by a nucleic acid molecule having a nucleotide sequence that is at least about 56%, preferably 57%, 58%, 59%, 60%, 65%, 70%, 75%, 80%, 85%, 90%, 95%, or 98% identical to the nucleic acid sequence encoding SEQ ID NO:147, SEQ ID NO:165, and isolated polypeptides or proteins which are encoded by a nucleic acid molecule having a nucleotide sequence which hybridizes under stringent hybridization conditions to a nucleic acid molecule having the nucleotide sequence of SEQ ID NO:145, 146, 163, or 164, a complement thereof, or the non-coding strand of the cDNA of ATCC Accession Number 207190 or 207191.

Also within the invention are polypeptides which are naturally occurring allelic variants of a polypeptide that includes the amino acid sequence of SEQ ID NO:147, or the amino acid sequence encoded by the cDNA of ATCC Accession Number 207190 or 207191, wherein the polypeptide is encoded by a nucleic acid molecule which hybridizes to a nucleic acid molecule having the sequence of SEQ ID NO:145, 146, 163, 164, or a complement thereof under stringent conditions.

The invention also features nucleic acid molecules that hybridize under stringent conditions to a nucleic acid molecule having the nucleotide sequence of SEQ ID NO:145, 146, 163, or 164, the cDNA of ATCC Accession Number 207190 or 207191, or a complement thereof. In other embodiments, the nucleic acid molecules are at least 390 (400, 500, 600, 800, 1000, 1250, 1500, 1750, 2000, 2250, 2500, 2750, 3000, 3250, 3500, 3750, 4000, 4250, 4500, 4750, 5000, 5025, or 5042) nucleotides in length and hybridize under stringent conditions to a nucleic acid molecule comprising the nucleotide sequence of SEQ ID NO:145, 146, 163, or 164, the cDNA of ATCC Accession Number 207190 or 207191, or a complement thereof.

In one embodiment, the invention provides an isolated nucleic acid molecule which is antisense to the coding strand of a nucleic acid of the invention.

Another aspect of the invention provides vectors, e.g., recombinant expression vectors, comprising a nucleic acid molecule of the invention. In another embodiment, the invention provides host cells containing such a vector or a nucleic acid molecule of the invention. The invention also provides methods for producing a polypeptide of the invention by culturing, in a suitable medium, a host cell of the invention containing a recombinant expression vector such that a polypeptide is produced.

Another aspect of this invention features isolated or recombinant proteins and polypeptides of the invention. Preferred proteins and polypeptides possess at least one biological activity possessed by the corresponding naturally-occurring human polypeptide. An activity, a biological activity, or a functional activity of a polypeptide or nucleic acid of the invention refers to an activity exerted by a protein, polypeptide or nucleic acid molecule of the invention on a responsive cell as determined in vivo, or in vitro, according to standard techniques. Such activities can be a direct activity, such as an association with or an enzymatic activity on a second protein, or an indirect activity, such as a cellular signaling activity mediated by interaction of the protein with a second protein.

A259 biological activities include, e.g., (1) the ability to form protein-protein interactions with proteins in the signaling pathway of the naturally-occurring polypeptide; (2) the ability to bind a ligand of the naturally-occurring polypeptide; (3) the ability to interact with an A259 ligand; and (4) the ability to modulate function, survival, morphology, migration, proliferation and/or differentiation of cells, e.g., of tissues in which it is expressed (e.g., osteoblasts, bone marrow, neural tissue).

A259 biological activities also include, e.g., (1) the ability to modulate, e.g., stabilize, protein-protein interactions (e.g., homophilic and/or heterophilic), and protein-ligand interactions, e.g., in receptor-ligand recognition; (2) ability to modulate signalling pathways; (3) ability to modulate cell-cell interactions, e.g., by acting as a cell-cell adhesion molecule, or by acting as a receptor for cell-cell adhesion molecules; (4) the ability to modulate interactions between cells and proteins (e.g., extracellular matrix proteins, e.g., collagens, fibrinogens, laminins, and fibronectin), e.g., by acting as a cell surface receptor; (5) the ability to interact, e.g., noncovalently interact, with an integrin β subunit; and (6) the ability to exhibit an activity of an integrin α10 or an integrin α1 subunit.

Still other A259 biological activities include, e.g., (1) the ability to modulate, e.g., initiate, an immune response, e.g., an inflammatory response; (2) the ability to modulate, e.g., initiate wound healing, e.g., by modulating platelet aggregation or by modulating fibroblast attachment to wound sites during wound contraction; and (3) the ability to stimulate fibrogenesis.

In one embodiment, a polypeptide of the invention has an amino acid sequence sufficiently identical to an identified domain of a polypeptide of the invention. As used herein, the term "sufficiently identical" refers to a first amino acid or nucleotide sequence which contains a sufficient or minimum number of identical or equivalent (e.g., with a similar side chain) amino acid residues or nucleotides to a second amino acid or nucleotide sequence such that the first and second amino acid or nucleotide sequences have a common structural domain and/or common functional activity. For example, amino acid or nucleotide sequences which contain a common structural domain having about 60% identity, preferably 65% identity, more preferably 75%, 85%, 95%, 98% or more identity are defined herein as sufficiently identical.

In one embodiment, an A259 protein includes at least one or more of the following domains: a signal sequence, an extracellular domain, a repeat domain, an I domain, an integrin alpha repeat domain, a transmembrane domain, and a cytoplasmic domain. In yet another embodiment, an A259 protein includes an extracellular domain and one or more repeat domains, and or one or more integrin alpha repeat domains, and is a soluble protein. In still another embodiment, an A259 protein includes an extracellular domain, one or more repeat domains, a transmembrane domain, a cytoplasmic domain, and is a receptor protein.

The polypeptides of the present invention, or biologically active portions thereof, can be operably linked to a heterologous amino acid sequence to form fusion proteins. The invention further features antibodies that specifically bind a polypeptide of the invention such as monoclonal or polyclonal antibodies. In addition, the polypeptides of the invention or biologically active portions thereof can be incorporated into pharmaceutical compositions, which optionally include pharmaceutically acceptable carriers.

In another aspect, the present invention provides methods for detecting the presence of the activity or expression of a polypeptide of the invention in a biological sample by contacting the biological sample with an agent capable of detecting an indicator of activity such that the presence of activity is detected in the biological sample.

In another aspect, the invention provides methods for modulating activity of a polypeptide of the invention comprising contacting a cell with an agent that modulates (inhibits or stimulates) the activity or expression of a polypeptide of the invention such that activity or expression in the cell is modulated. In one embodiment, the agent is an antibody that specifically binds to a polypeptide of the invention.

In another embodiment, the agent modulates expression of a polypeptide of the invention by modulating transcription, splicing, or translation of an mRNA encoding a polypeptide of the invention. In yet another embodiment, the agent is a nucleic acid molecule having a nucleotide sequence that is antisense to the coding strand of an mRNA encoding a polypeptide of the invention.

The present invention also provides methods to treat a subject having a disorder characterized by aberrant activity of a polypeptide of the invention or aberrant expression of a nucleic acid of the invention by administering an agent which is a modulator of the activity of a polypeptide of the invention or a modulator of the expression of a nucleic acid of the invention to the subject. In one embodiment, the modulator is a protein of the invention. In another embodiment, the modulator is a nucleic acid of the invention. In other embodiments, the modulator is a peptide, peptidomimetic, or other small molecule.

The present invention also provides diagnostic assays for identifying the presence or absence of a genetic lesion or mutation characterized by at least one of: (i) aberrant modification or mutation of a gene encoding a polypeptide of the invention, (ii) mis-regulation of a gene encoding a polypeptide of the invention, and (iii) aberrant post-translational modification of the invention wherein a wild-type form of the gene encodes a protein having the activity of the polypeptide of the invention.

In another aspect, the invention provides a method for identifying a compound that binds to or modulates the activity of a polypeptide of the invention. In general, such methods entail measuring a biological activity of the polypeptide in the presence and absence of a test compound and identifying those compounds which alter the activity of the polypeptide.

The invention also features methods for identifying a compound which modulates the expression of a polypeptide or nucleic acid of the invention by measuring the expression of the polypeptide or nucleic acid in the presence and absence of the compound

BRIEF DESCRIPTION OF THE DRAWINGS

FIG. 1 depicts an alignment of an amino acid sequence of Tango-77 (T77; SEQ ID NO:2) with IL-IRA (SEQ ID NO:14), and IL-1β (SEQ ID NO:15).

FIG. 2 depicts an alignment of the amino acid sequence of murine SPOIL-I (also referred to as murine or mTANGO 080-I) (corresponding amino acids 1 to 98 of SEQ ID NO:2), murine IL-1ra (Swissprot™ Accession Number P25085) (SEQ ID NO:10), murine IL-11a (Swissprot™ Accession Number P01582) (SEQ ID NO:1) and murine IL-1β (Swissprot™ Accession Number P10749) (SEQ ID NO:12).

FIG. 3 depicts a multiple sequence alignment of the amino acid sequence of murine SPOIL-I (corresponding to SEQ ID NO:2), the amino acid sequence of murine SPOIL-II (corresponding to SEQ ID NO:25), the amino acid sequence of human SPOIL-I (corresponding to SEQ ID NO:14), and the amino acid sequence of human SPOIL-II (corresponding to SEQ ID NO:18). Asterisks indicate amino acid residues that are conserved between SPOIL family members.

FIG. 4 depicts a multiple sequence alignment of the amino acid sequence of murine IL-1α (Swissprot™ Accession Number P01582) (SEQ ID NO:11), murine IL-1β (Swissprot™ Accession Number P10749) (SEQ ID NO:12), murine IL-1ra (Swissprot™ Accession Number P25085) (SEQ ID NO:10), the amino acid sequence of murine SPOIL-I (also referred to as murine or mTANGO 080-I) (corresponding amino acids 1 to 98 of SEQ ID NO:2), the amino acid sequence of murine SPOIL-II (also referred to as murine or mTANGO 080-II) (corresponding amino acids 1 to 160 of SEQ ID NO:25), the amino acid sequence of human SPOIL-I (corresponding nucleotides 1 to 169 of SEQ ID NO:14), and the amino acid sequence of human SPOIL-II (corresponding to nucleotides 1 to 208 of SEQ ID NO:16). Asterisks indicate amino acid residues that are conserved between SPOIL proteins and IL-1ra.

FIG. 5 is a diagram depicting the relationship between the NEOKINE proteins of the instant invention. The figure depicts the functional domains of the NEOKINE family members, human NEOKINE-1 (SEQ ID NO:2), mouse NEOKINE-1 (SEQ ID NO:5), rat NEOKINE-1 (SEQ ID NO:8), and macaque NEOKINE-1 (SEQ ID NO:21). The NEOKINE CXC signature motifs are indicated in italics. The conserved cysteine residues are indicated with asterisks.

FIG. 9A depicts an alignment of amino acids 37-90 of human A259 (SEQ ID NO:35) with a consensus integrin alpha repeat domain derived from a hidden Markov model (SEQ ID NO:40).

FIG. 9B depicts an alignment of amino acids 421-472 of human A259 (SEQ ID NO:36) with a consensus integrin alpha repeat domain derived from a hidden Markov model (SEQ ID NO:40).

FIG. 9C depicts an alignment of amino acids 476-532 of human A259 (SEQ ID NO:37) with a consensus integrin alpha repeat domain derived from a hidden Markov model (SEQ ID NO:40).

FIG. 9D depicts an alignment of amino acids 538-593 of human A259 (SEQ ID NO:38) with a consensus integrin alpha repeat domain derived from a hidden Markov model (SEQ ID NO:40).

FIG. 9E depicts an alignment of amino acids 600-654 of human A259 (SEQ ID NO:39) with a consensus integrin alpha repeat domain derived from a hidden Markov model (SEQ ID NO:40).

DETAILED DESCRIPTION OF THE INVENTION

Delta 3

Figure 6:
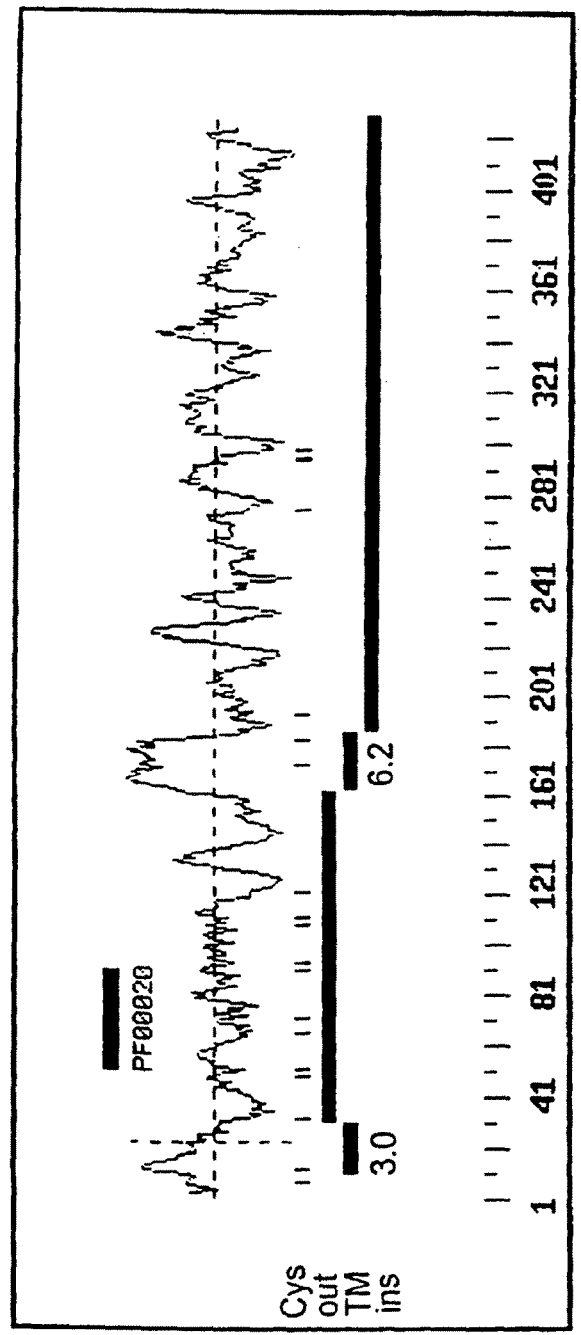
FIG. 6 is a hydropathy plot of T129. The location of the predicted transmembrane (TM), cytoplasmic (IN), and extracellular (OUT) domains are indicated as are the position of cysteines (cys; vertical bars immediately below the plot). Relative hydrophilicity is shown above the dotted line, and relative hydrophobicity is shown below the dotted line.

Notch, first identified in *Drosophila*, is the founding member of a family of transmembrane receptor proteins that mediate cell responses to intrinsic and/or extrinsic developmental cues. The cellular response to Notch signaling can be differentiation, proliferation and/or apoptosis depending on the specific developmental program. Defects in the Notch signaling pathway may be involved in neurological, vascular and hematologic diseases.

Analysis of gene expression patterns for Notch and its ligands has indicated that Notch signaling may have a role in hematopoiesis (Milner and Bigas (1999) *Blood* 93:2431). Notch-I was also shown to be involved in determination of T-cell education and fate in the thymus (Robey (1999) *An Rev Immunol* 17:283). Furthermore, a subset of human T-cell leukemia patients harbor a translocation involving the Notch 1 gene which results in a constitutively active Notch protein (Ellisen et al. (1991) *Cell* 66:649). Compelling evidence that the Notch signaling pathway is involved in B-cell development is seen in B-cell malignancies induced by Epstein-Barr virus (EBV). EBNA2, the transforming protein of EBV, transactivates cellular genes by direct interaction with a primary component of the Notch pathway (Henkel et al. (1994) *Science* 265:92).

It has recently been shown that the human Notch3 gene, located on chromosome 19, is mutated in CADASIL patients (Joutel et al., (1996) *Nature* 383: 707-710). CADASIL causes a type of stroke and dementia whose key features include recurrent subcortical ischemic events, progressive vascular dementia, craniofacial paralysis, migraine and mood disorders with severe depression (Chabriat et al., (1995) *Lancet* 346: 934-939). Pathological examination reveals multiple small, deep cerebral infarcts, a leukoencephalopathy and a non-atherosclerotic, non-amyloid angiopathy involving mainly the small cerebral arteries (Baudrimont et al., (1993) *Stroke* 24: 122-125). Severe alterations of vascular smooth muscle cells are evident on ultrastructural analysis (Ruchoux et al., (1995) *Acta. Neuropathol.* 89:500-512). Therefore, disruption of the Notch signaling pathway appears to be responsible for CADASIL stroke and dementia. Defects in the Notch signaling pathway may also be involved in other neurological diseases, e.g., Alzheimer's disease.

The Notch signaling pathway comprises Notch proteins, which are membrane proteins, and proteins interacting with Notch proteins, termed Delta proteins. The product of the Delta gene, acting as a ligand, and that of the Notch gene, acting as a receptor, are key components in a lateral-inhibition signaling pathway that regulates the detailed patterning of many different tissues in *Drosophila* (Vassin et al., (1987) *EMBO J.* 6:3431-3440; Kopczynski et al., (1988) *Genes Dev.* 2:1723-1735; Fehon et al., (1990) *Cell* 61:523-534; Artavanis-Tsakonas et al., (1991) *Trends, Genet. Sci.* 7:403-407; Heitzler et al., (1991) *Cell* 64: 1083-1092; Greenwald et al., (1992) *Cell* 68: 271-281; Fortini et al., (1993) *Cell* 75:

124501247; and Muskavitch (1994) Devl. Biol. 166:415-430). During neurogenesis in particular, neural precursors, by expressing Delta, inhibit neighboring Notch-expressing cells from becoming committed to a neural fate. Mutations leading to a failure of lateral inhibition cause an overproduction of neurons, giving rise to a phenotype termed the "neurogenic phenotype" in *Drosophila*. For example, loss of Notch 1 leads to somite defects and embryonic death in mice, whereas constitutively active mutant forms of Notch 1 appear to inhibit cell differentiation in *Xenopus* and in cultured mammalian cells (Swiatek et al. (1994) *Genes Dev.* 8:707; Conlon et al. (1995) *J. Development* 121:1533; Lopan et al. (1994) *Development* 120:2385; and Nye et al. (1994) Development 120:2421). Furthermore, loss of Dll1 function in mice leads to excessive neuronal differentiation, resulting in severe patterning defects in the paraxial mesoderm and a hyperplastic central nervous system (CNS) (Hrabe de Angelis et al. (1997) *Nature* 386:717). Thus, the Notch signaling pathway, in particular Delta proteins, mediate lateral inhibition during neurogenesis so that only a limited proportion of cells having the potential to become neurons will in fact differentiate into neurons.

The Notch family of proteins are transmembrane receptors containing several conserved peptide motifs. The extracellular domains contain many tandemly repeated copies of an epidermal growth factor (EGF) like motif. The intracellular domains contain six copies of another conserved motif, termed the Cdc10/ankyrin repeat.

A protein interacting with Notch was first discovered in *Drosophila* and has been called Delta protein. This protein encodes a transmembrane protein ligand, which contains tandem arrays of epidermal growth factor-like repeats in the extracellular domain. The Delta and Notch proteins can directly bind to each other and specific EGF-like domains are sufficient and necessary for this binding (Fehon et al., (1990) *Cell* 61:523-534; Rebay et al., (1991) *Cell* 67:687-699; and Lieber et al., (1992) Neuron 9: 847-859).

It is also possible that soluble forms of the protein also exist. Such soluble isoforms can arise through variable splicing of the Delta3 gene or alternatively as a result of proteolysis of a membranous isoform. In fact, a splice variant of a chicken Delta protein have been described in PCT Publication No. WO 97/01571 (Jan. 16, 1997). Furthermore, the human Delta-like polypeptide Dlk is a soluble protein (Jansen et al. (1994) *Eur. J. Biochem.* 225:83-92).

In addition to the *Drosophila* Delta protein, a chick Delta ortholog, C-Delta protein (Henrique et al., (1995) Nature 375: 787-790 and GenBank Accession No. U26590) two *Xenopus* orthologs, X-Delta-1 and X-Delta-2 (Chitnis et al., (1995) Nature 375:761-766 and GenBank Accession Nos. L42229 and U70843), a mouse ortholog (GenBank Accession No. X80903), a delta-like human gene 1 (Dlk) (Bettenhausen et al., (1995) Development 121:2407-2418) a rat ortholog (GenBank Accession No. U78889), and a Zebrafish ortholog (GenBank Accession No. Y11760) have been identified.

The present invention is based at least in part on the discovery of a novel gene encoding a human Delta protein referred to herein as "hDelta3" polypeptide, and the mouse equivalent referred to herein as "mDelta3". An exemplary hDelta3 has been deposited with the ATCC® on Mar. 5, 1997 and has been assigned ATCC® GenBank Accession Number 98348. The human Delta3 gene maps to human chromosome 15.

The DNA sequence of human Delta3 including 5' and 3' non-coding sequences is shown in SEQ ID NO:1, the coding sequence is shown in SEQ ID NO:3, and the deduced amino acid sequence of the human Delta3 protein is shown in SEQ ID NO: 2. The DNA sequence of mouse Delta3 including 5' and 3' non-coding sequences is shown in SEQ ID NO:24 and the coding sequence is shown in SEQ ID NO:26. The deduced amino acid sequence of the mouse Delta3 protein is shown in SEQ ID NO:25.

Human Delta3 is expressed in endothelial cells and in fact was cloned from a human microvascular endothelial cell library. Northern blot analysis of RNA prepared from a number of different human tissues, indicate that a 3.5 kb Delta3 mRNA transcript is present in fetal brain, lung, liver and kidney, and adult heart, placenta, lung, skeletal muscle, kidney, pancreas, spleen, thymus, prostate, testis, ovary, small intestine and colon. Low levels of Delta3 mRNA were also detected in adult brain and adult liver. However, no Delta3 mRNA was detected in peripheral blood leukocytes. These results indicate that Delta3 is expressed in a tissue-specific manner. Further, expression in human microvascular endothelial cells was found to be up-regulated (about 2-3 fold) in cells that had been stimulated with certain growth factors (e.g., basic fibroblast growth factor (bFGF) or vascular endothelial growth factor (VEGF)). In addition, strong expression of human Delta3 was observed in the colorectal carcinoma cell line, SW480. Furthermore, expression of hDelta3 has been shown to be induced in response to proliferation and differentiation signals (See Examples). Thus, the Delta3 gene, in particular, the hDelta3 gene, is a gene whose expression in a cell changes with the state of proliferative and/or differentiative state of cells.

In situ hybridization was performed on a wide range of murine adult and embryonic tissues using a probe complementary to mRNA of mDelta3. Expression was most abundant and widespread during embryogenesis. Strongest expression was observed in the eye of all the embryonic ages tested. Signal in a pattern suggestive of neuronal expression was not observed in any other tissues making the expression in the eye unique. Ubiquitous expression was also detected in lung, thymus and brown fat during embryogenesis. A multifocal, scattered signal was also observed throughout the embryo. This signal pattern was more focused in the cortical region of the kidney and outlining the intestinal tract. Adult expression was highest in the ovary and the cortical regions of the kidney and adrenal gland. This is consistent with Delta3's role as a regulator of cell growth and/or differentiation.

As predicted from the nucleotide sequence of the nucleic acid encoding hDelta3, the novel, full-length hDelta3 polypeptide comprises 685 amino acids and is similar and structure to Delta proteins obtained from other organisms (discussed below). An amino acid sequence analysis of Delta3 proteins predicts that the protein comprises at least the structural domains described herein. First, human and mouse Delta3 have a signal peptide, corresponding to amino acid 1 to amino acid 16, amino acid 1 to amino acid 17, amino acid 1 to amino acid 18, amino acid 1 to amino acid 19 or amino acid 1 to amino acid 20 of SEQ ID NOs: 2 or 25. The signal sequence is normally cleaved during processing of the mature protein. In such embodiments of the invention, the domains and the mature protein resulting from cleavage of such signal peptides are also included herein. For example, the cleavage of a signal sequence consisting of amino acids 1 to 17 results in an extracellular domain consisting of amino acids 18 to 529 of SEQ ID No 0.2 and the mature Delta3 polypeptide corresponding to amino acids 18 to 685 of SEQ ID NO: 2.

Second, human and mouse Delta3 have protein interaction domains such as a Delta Serrated lag-2 (DSL) motif corresponding to amino acid 173 to amino acid 217 of SEQ ID NO: 2 and amino acid 174 to amino acid 218 of SEQ ID NO: 25, as well as eight epidermal growth factor (EGF)-like repeats.

In addition, Delta3 proteins have a transmembrane domain, i.e., in human Delta3 the transmembrane domain corresponds to about amino acid 530 to about amino acid 553 of SEQ ID NO: 2, and in mouse Delta3, amino acid 531 to amino acid 554 of SEQ ID NO: 25. Delta3 proteins have also have a cytoplasmic domain corresponding to about amino acid 554 to about amino acid 685 of SEQ ID NO: 2 or amino acid 555 to amino acid 686 of SEQ ID NO: 25. Accordingly, sequence analysis for conserved domains of Delta3 amino acid sequence shows that the protein is likely a transmembrane protein having an extracellular domain corresponding to about amino acid 1 to about amino acid 529 of SEQ ID NO:2, about amino acid 18 to about amino acid 529 of SEQ ID NO: 2, amino acid 1 to about amino acid 530 of SEQ ID NO: 25, or amino acid 18 to 530 of SEQ ID NO: 25, said extracellular domain comprising a DSL motif and eight EGF-like domains. The Delta3 protein further comprises a transmembrane domain and a cytoplasmic domain.

Human Delta3 protein is similar in structure and in sequence to the Delta proteins identified in *Drosophila, Xenopus*, zebrafish, chicken, rat, mouse, rat, and human. Applicants have aligned known Delta proteins with the Delta3 protein of the present invention. This alignment contains the following Delta proteins: a mouse Delta1 protein (m-delta1), rat Delta-1 protein (r-delta1), a human Delta-1 protein (h-delta1), a *Xenopus* Delta1 protein (x-delta1), a chicken Delta1 protein (c-delta1), a zebrafish Delta1 protein (z-delta1), a second *Xenopus* Delta protein α-delta2), as well as the human Delta3 protein (h-delta3), and a *Drosophila* Delta1 protein (d-delta). The amino acid sequence of h-delta1 is the amino acid sequence published in PCT Publication WO 97/01571 (Jan. 16, 1997) which is incomplete and contains numerous errors, as stated in the application. Since the amino acid sequence alignment has been done using the pileup computer program (GCG Package), the order of the amino acid sequences reflects the relative identity between the different Delta proteins. Accordingly, the *Drosophila* protein, which corresponds to the bottom sequence in the alignment is most distant from the other Delta proteins.

The alignment shows that hDelta3, which is listed second to the last, is the second most distant Delta protein from the previously identified mouse, rat, human, *Xenopus*, zebrafish, and chicken delta protein. Accordingly, hDelta3 protein is significantly different from the previously described human Delta protein, as well as the Delta proteins from the other species. Interestingly, the hDelta3 protein has an amino acid sequence which is equally distant from both *Xenopus* proteins, i.e., Delta1 and Delta2, suggesting that hDelta3 does not correspond to either of the *Xenopus* Delta proteins. Therefore, the newly isolated polypeptide has been termed hDelta3 and the previously identified mouse, rat, human, zebrafish, and *Xenopus* Delta proteins are termed Delta1 proteins herein and the two *Xenopus* proteins are termed Delta1 and Delta2 proteins. The difference between hDelta3 protein and previously isolated Delta proteins can also be visualized by comparing the percentage similarity or identity between hDelta3 and the previously identified Delta1 and Delta2 proteins on one hand (Table 1), and the percent similarity or identity of a Delta1 protein with the other Delta1 and Delta2 proteins (Table II).

A hallmark of Notch ligands such as Jagged-1, is the ability to block the differentiation of the C2C12 cell line from myoblasts into myotubes when co-cultured with NIH3T3 cells under low mitogenic conditions. When C2C12 cells were co-cultured with NIH3T3 cells, which were engineered to express hDelta3, differentiation of C2C12 cells from myoblasts to myotubes was blocked in a similar fashion as has been described for other Notch ligands such as Jagged-1. Therefore, the hDelta3 gene is likely to encode a polypeptide which functions as a bona fide Notch ligand. Indeed, the data presented in Section 5.6, below, indicates that hDelta3 is a bona fide Notch ligand.

Table I indicates the percent similarity and identity between human Delta3, the Delta1 disclosed in PCT Publication No. WO 97/01571 (Jan. 16, 1997) and non-human Delta1 proteins. Since the amino acid sequence of the human Delta1 protein that is disclosed in PCT Publication No. WO 97/01571 (Jan. 16, 1997) is incomplete, the percentage similarity and identity was determined using a portion of the human Delta1 amino acid sequence which seems most reliable. The portion of the amino acid sequence used corresponds to amino acids 214-370 of the human Delta1 amino acid sequence shown in FIG. 11 of the PCT Publication No. WO 97/01571 (Jan. 16, 1997).

TABLE I

Percentage similarity between the amino acid sequence of human Delta3 (SEQ ID NO: 2) and that of the various Delta proteins

| GenBank | Accession NO: | SEQ ID NO: | % identity | % similarity |
|---|---|---|---|---|
| Human Delta1 | N.A. | (SEQ ID NO: 6) | 50 | 66 |
| Mouse Delta1 | X80903 | (SEQ ID NO: 4) | 53 | 70 |
| rat Delta1 | U78889 | (SEQ ID NO: 5) | 54 | 70 |
| chicken Delta1 | U26590 | (SEQ ID NO: 8) | 52 | 68 |
| *Xenopus* Delta1 | L42229 | (SEQ ID NO: 7) | 51 | 68 |
| zebrafish Delta1 | Y11760 | (SEQ ID NO: 9) | 48 | 67 |
| *Xenopus* Delta2 | U70843 | (SEQ ID NO: 10) | 47 | 65 |
| *Drosophila* Delta1 | AA142228 | (SEQ ID NO: 11) | 40 | 58 |
| hDelta-like (dlk) | U15979 | | 33 | 55 |

Table II indicates the percent similarity and identity between human Delta1 disclosed in PCT Publication No. WO 97/01571 (1997) and non-human Delta1 proteins. Since the amino acid sequence of the human Delta1 protein that is disclosed in PCT Publication No. WO 97/01571 (1997) is incomplete, the percentage similarity and identity was determined using a portion of the human Delta1 amino acid sequence which seems most reliable. The portion of the amino acid sequence used corresponds to amino acids 214-370 of the human Delta1 amino acid sequence shown in FIG. 11 of the PCT application.

TABLE II

Percentage similarity between human Delta1 and the various non-human Delta1 or Delta2 proteins

| GenBank | Accession | SEQ ID NO: | % identity | % similarity NO: |
|---|---|---|---|---|
| Human Delta1 | N.A. | (SEQ ID NO: 6) | 100 | 100 |
| mouseDelta1 | X80903 | (SEQ ID NO: 4) | 86 | 95 |
| rat Delta1 | U78889 | (SEQ ID NO: 5) | 88 | 94 |
| chicken Delta1 | U26590 | (SEQ ID NO: 8) | 85 | 89 |
| *Xenopus* Delta1 | L42229 | (SEQ ID NO: 7) | 78 | 84 |
| zebrafish Delta1 | Y11760 | (SEQ ID NO: 9) | 69 | 80 |
| *Xenopus* Delta2 | U70843 | (SEQ ID NO: 10) | 57 | 70 |
| *Drosophila* Delta1 | AA142228 | (SEQ ID NO: 11) | 45 | 62 |
| hDelta-like (dlk) | U15979 | | 37 | 55 |

Accordingly, Table I indicates that hDelta3 is only approximately 66% similar to the human Delta1 protein; approximately 70% similar to the mouse Delta1 protein; approximately 70% similar to the rat Delta1 protein; approximately 68% similar to the chick Delta1 protein; approximately 68% similar to the *Xenopus* Delta1 protein, approximately 70% similar to the *Xenopus* Delta2 protein and approximately 58% similar to the *Drosophila* Delta1 protein. However, as shown in Table II, the human-Delta1 protein is very similar to the mouse, rat, chick, *Xenopus*, zebrafish, and *Drosophila* Delta1 and the *Xenopus* Delta2 proteins. In addition, mouse and rat Delta1 proteins are about 95% similar. Thus, the amino acid sequence of the orthologs of the Delta1 protein share greater similarity and identity with each other than with the human Delta3 protein of the invention, indicating that at least two families of Delta proteins exist.

The difference between the newly isolated hDelta3 protein and the previously identified Delta1 and Delta2 proteins can also be seen by creating a phylogenic tree using the Growtree Phylogram computer program (GCG Package). The result of this analysis, indicates that h-Delta3 is on a different "branch" in the phylogenic tree from the other Delta proteins, thus confirming that hDelta3 protein is more distant from the other Delta1 and Delta2 proteins than they are distant from each other. According to the analysis, and as predicted by the sequence alignment, only the *Drosophila* Delta protein is more distantly related to the previously identified mouse, rat, *Xenopus*, chicken, zebrafish and human Delta proteins than hDelta3. Thus, the newly isolated hDelta3 protein is a member of a different subspecies of the family of Delta proteins.

Notwithstanding that each animal species is likely to have at least two or three members (e.g., Delta1, Delta 2, and Delta3), the DSL region, the eight EGF repeats and the TM appear to be highly conserved throughout species. However, these domains of the hDelta3 protein differ more from the corresponding domains in the other Delta proteins than the corresponding domains in the other Delta differ from one another.

A comparison of human and mouse Delta3 shows that they are 86.6% identical and 88.2% similar. The polypeptides were aligned with the BLAST program using Blosum62, gap weight 12 and length weight 4. One gap was introduced at amino acid position twenty one due to an extra codon present in mouse Delta3. The skilled artisan will appreciate that the domains identified in hDelta3 protein of the present invention are also present in corresponding positions in mouse Delta3.

Furthermore, as set forth in the examples presented below, Delta3 has been localized to human chromosome 15 in a region close to the framework markers D15S1244 and D15S144. Interestingly, the region on chromosome 15 that is flanked by the markers D15S1040 and D15S118 has been shown to be genetically linked with the disease called Agenesis of the Corpus Callosum with Peripheral Neuropathy (ACCPN) (Casaubon et al. (1996) *Am J. Hum. Genet.* 58:28). No specific gene has so far been linked to this disease. Accordingly, since Delta3 is localized to a chromosomal region genetically linked to ACCPN and Delta3 is a member of the Notch signaling pathway, defects in which have been associated with a number of neurological diseases or conditions, Delta3 is likely to be the gene involved in ACCPN.

ACCPN, which is also termed Andermann syndrome (MIM 218000), is an autosomal recessive disorder that occurs with a high prevalence in the French Canadian population in the Charlevoix and Saguenay-Lac St Jean region in Quebec. The disease is characterized by a progressive peripheral neuropathy caused by axonal degeneration and a central nervous system (CNS) malformation characterized by the absence of hypoplasia of the corpus callosum. The disorder appears early in life, is progressive and results in death in the third decade of life of the subject.

Accordingly, certain aspects of the present invention relate to Delta3 proteins, nucleic acid molecules encoding Delta3 proteins, antibodies immunoreactive with Delta3 proteins, and preparations of such compositions. In addition, drug discovery assays are provided for identifying agents that modulate the biological function of Delta proteins, e.g., Delta3 proteins (i.e. agonists or antagonists), such as by binding to Delta3 or by altering the interaction of Delta3 with either downstream or upstream elements in the Delta/Notch signal transduction pathway by altering the interaction between Delta3 and a Delta3 binding protein. Such agents can be useful therapeutically, for example, to alter cell growth and/or differentiation or induction of apoptosis. Moreover, the present invention provides diagnostic and therapeutic assays and reagents for detecting and treating disorders involving an aberrant Delta3 activity, for example, aberrant expression (or loss thereof) of Delta3 gene or which are associated with a specific Delta allele, e.g., a Delta3 allele.

The term "activity," for the purposes herein refers to an activity exerted by a polypeptide of the invention on a responsive cell as determined, in vivo or in vitro, according to standard techniques. An activity can refer to an effector or antigenic function that is directly or indirectly performed by a Delta3 polypeptide (whether in its native or denatured conformation), or by any subsequence thereof. Effector functions include, for example, receptor binding or activation, induction of differentiation, mitogenic or growth promoting activity, induction of apoptosis, signal transduction, immune modulation, DNA regulatory functions and the like, whether presently known or inherent. Antigenic functions include possession of an epitope or antigenic site that is capable of binding antibodies raised against a naturally-occurring or denatured Delta3 polypeptide or fragment thereof. Accordingly, an activity of a Delta3 protein can be binding to a receptor, such as Notch. An activity of a Delta3 protein can also be modulation of cell proliferation and/or differentiation, or cell death in a target cell having an appropriate receptor. A target cell can be, e.g., a neural cell, an endothelial cell, or a cancer cell.

The term "aberrant Delta3 activity" or "abnormal Delta3 activity" is intended to encompass an activity of Delta3 which differs from the same Delta3 expression or activity in a healthy subject. An aberrant Delta3 activity can result, e.g., from a mutation in the protein, which results, e.g., in lower or higher binding affinity to a receptor. An aberrant Delta3 activity can also result from a lower or higher level of Delta3 on cells, which can result, e.g., from aberrant transcription, splicing, or translation of the Delta3 gene. For example, an aberrant Delta3 activity can result from an abnormal promoter activity. An aberrant Delta3 activity can also result from an aberrant signalling through the cytoplasmic domain of the Delta3 protein, such that, e.g., an aberrant signal is transduced. Aberrant signalling can result from a mutation in the cytoplasmic domain of Delta3 or, alternatively, from the contact with an abnormal cytoplasmic protein. An aberrant Delta3 activity can also result from contact of a Delta3 protein with an aberrant receptor, e.g., abnormal Notch protein.

The term "allele", which is used interchangeably herein with "allelic variant" refers to alternative forms of a gene, nucleic acid or portions thereof, as well as to a polypeptide encoded by said gene, nucleic acid, or portion thereof. Nucleic acid alleles occupy the same locus or position on homologous chromosomes. When a subject has two identical alleles of a gene, the subject is said to be homozygous for the gene or allele. When a subject has two different alleles of a gene, the subject is said to be heterozygous for the gene. Alleles of a specific gene can differ from each other in a single nucleotide, or several nucleotides, and can include substitutions, deletions, and insertions of nucleotides. An allele of a gene can also be a form of a gene containing a mutation.

The term "allelic variant of a polymorphic region of a Delta3 gene" refers to a region of a Delta gene having one of several nucleotide sequences found in that region of the gene in other individuals, as well as to polypeptides encoded by nucleic acid molecules comprising said sequences.

The term "agonist", as used herein, is meant to refer to an agent that upregulates (e.g., potentiates or supplements) Delta3 expression, levels and/or activity. It is to be understood that a Delta3 agonist can include a compound which increases signaling from a Delta3 protein, e.g., a compound bound to Delta3, such as a stimulatory form of a toporythmic protein or a small molecule. A Delta3 agonist can also, for example, be a compound which modulates the expression or activity of a protein which is located upstream or downstream of Delta3 and or which interacts with Delta3.

"Antagonist" as used herein is meant to refer to an agent that downregulates (e.g., suppresses or inhibits) Delta3 expression, levels and/or activity. A Delta3 antagonist can, for example, be a compound which decreases signalling from a Delta3 protein, e.g., a compound binding to Delta3 such as an inhibitory form of a toporythmic protein, or a small molecule. A Delta3 antagonist can include compounds that inhibit the interaction between a Delta3 protein and another molecule, e.g., a toporythmic protein. A Delta3 antagonist can also be a compound which modulates the expression or activity of a protein which is located upstream or downstream of Delta3 and/or which interacts with Delta3.

The term "antibody" as used herein refers to immunoglobulin molecules and immunologically active portions of immunoglobulin molecules, i.e., molecules that contain an antigen biding site which specifically binds an antigen, such as a polypeptide of the invention, e.g., an epitope of a polypeptide of the invention. A molecule The term "antibody" as used herein refers to immunoglobulin molecules and immunologically active portions of immunoglobulin molecules, i.e., molecules that contain an antigen binding site which specifically binds an antigen, such as a polypeptide of the invention, e.g., an epitope of a polypeptide of the invention. A molecule which specifically binds to a given polypeptide of the invention is a molecule which binds the polypeptide, but does not substantially bind other molecules in a sample, e.g., a biological sample, which naturally contains the polypeptide. Examples of immunologically active portions of immunoglobulin molecules include F(ab) and F(ab')$_2$ fragments which can be generated by treating the antibody with an enzyme such as pepsin. The invention provides polyclonal and monoclonal antibodies. The term "monoclonal antibody" or "monoclonal antibody composition", as used herein, refers to a population of antibody molecules that contain only one species of an antigen binding site capable of immunoreacting with a particular epitope.

"Cells," "host cells" or "recombinant host cells" are terms used interchangeably herein. It is understood that such terms refer not only to the particular subject cell but to the progeny or potential progeny of such a cell. Because certain modifications may occur in succeeding generations due to either mutation or environmental influences, such progeny may not, in fact, be identical to the parent cell, but are still included within the scope of the term as used herein.

"Complementary" sequences as used herein refer to sequences which have sufficient complementarity to be able to hybridize, forming a stable duplex.

A "delivery complex" shall mean a targeting means (e.g., a molecule that results in higher affinity binding of a gene, protein, polypeptide or peptide to a target cell surface and/or increased cellular uptake by a target cell). Examples of targeting means include: sterols (e.g., cholesterol), lipids (e.g., a cationic lipid, virosome or liposome), viruses (e.g., adenovirus, adeno-associated virus, and retrovirus) or target cell specific binding agents (e.g., ligands recognized by target cell specific receptors). Preferred complexes are sufficiently stable in vivo to prevent significant uncoupling prior to internalization by the target cell. However, the complex is cleavable under appropriate conditions within the cell so that the gene, protein, polypeptide or peptide is released in a functional form.

As is well known, genes for a particular polypeptide may exist in single or multiple copies within the genome of an individual. Such duplicate genes may be identical or may have certain modifications, including nucleotide substitutions, additions or deletions, which all still code for polypeptides having substantially the same activity. The term "DNA sequence encoding a Delta3 polypeptide" may thus refer to one or more genes within a particular individual. Moreover, certain differences in nucleotide sequences may exist between individual organisms, which are called alleles. Such allelic differences may or may not result in differences in amino acid sequence of the encoded polypeptide yet still encode a protein with the same biological activity.

The term "Delta3 therapeutic" refers to various compositions of Delta3 modulators (e.g., agonists or antagonists), such as polypeptides, antibodies, peptidomimetics, small molecules and nucleic acids which are capable of mimicking or potentiating (agonizing) or inhibiting suppressing (antagonizing) Delta3 expression, levels, or activity, e.g., which are capable of agonizing or antagonizing the effects of a naturally-occurring Delta3 protein.

The terms "Delta3 polypeptide" and "Delta3 protein" are intended to encompass, e.g., Delta3 polypeptides which have at least one activity of a native Delta3 polypeptide, or can, e.g., antagonize or agonize at least one biological activity of a native Delta3 polypeptide.

A "fusion protein" is a fusion of a first amino acid sequence encoding one of the subject Delta3 polypeptides with a second, heterologous amino acid sequence. In general, a fusion protein can be represented by the general formula X-Delta3-Y, wherein Delta3 represents a portion of the protein which is derived from one of the Delta3 proteins of the invention, and X and Y are independently absent or represent amino acid sequences which are heterologous to (that is, not related to) one of the Delta3 sequences in an organism, including naturally-occurring mutants. Among the Delta3 fusion protein is a Delta3-Ig fusion protein.

As used herein, the term "gene" or "recombinant gene", as applied to Delta3, refers to a nucleic acid molecule comprising an open reading frame encoding one of the Delta3 polypeptides of the present invention. In one embodiment, these terms relate to a cDNa sequence including, but not limited to a nucelci acid sequence obtained via reverse transcription of an mRNA molecule.

The term "growth state" of a cell refers to the proliferative state of a cell as well as to its differentiative state. Accordingly, the term refers to the phase of the cell cycle in which the cell is, e.g., G0, G1, G2, prophase, metaphase, or telophase, as well as to its state of differentiation, e.g., undifferentiated, partially differentiated, or fully differentiated. Without wanting to be limited, differentiation of a cell is usually accompanied by a decrease in the proliferative rate of a cell.

"Homology" or "identity" or "similarity" refers to sequence similarity between two peptides or between two nucleic acid molecules. Homology can be determined by comparing a position in each sequence which may be aligned for purposes of comparison. When a position in the compared sequence is occupied by the same base or amino acid, then the molecules are identical at that position. A degree of homology or similarity or identity between nucleic acid sequences is a function of the number of identical or matching nucleotides at positions shared by the nucleic acid sequences. A degree of identity of amino acid sequences is a function of the number of identical amino acids at positions shared by the amino acid sequences. Likewise, a degree of identity of nucleic acid sequences is a function of the number of identical nucleic acids at positions shared by the nucleic acid sequences.

Furthermore, a degree of homology or similarity of amino acid sequences is a function of the number of conserved amino acids at positions shared by the amino acid sequences. A sequence which is "unrelated" or "non-homologous" with one of the hDelta3 sequences of the present invention typically is a sequence which shares less than 40% identity, though preferably less than 25% identity with one of the hDelta3 sequences of the present invention.

To determine the percent identity of two amino acid sequences or of two nucleic acids, the sequences are aligned for optimal comparison purposes (e.g., gaps can be introduced in the sequence of a first amino acid or nucleic acid sequence for optimal alignment with a second amino or nucleic acid sequence). The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position. The percent identity between the two sequences is a function of the number of identical positions shared by the sequences (i.e., % identity=# of identical positions/total # of positions (e.g., overlapping positions)×100). In one embodiment the two sequences are the same length. In another embodiment, the mouse Delta3 polypeptide is one amino acid longer than human Delta3.

Preferably, the determination of percent identity between two sequences is accomplished using a mathematical algorithm. A preferred, non-limiting example of a mathematical algorithm utilized for the comparison of two sequences is the algorithm of Karlin and Altschul (1990) *Proc. Natl. Acad. Sci. USA* 87:2264-2268, modified as in Karlin and Altschul (1993) *Proc. Natl. Acad. Sci. USA* 90:5873-5877. Such an algorithm is incorporated into the NBLAST and XBLAST programs of Altschul, et al. (1990) *J. Mol. Biol.* 215:403-410. BLAST nucleotide searches can be performed with the NBLAST program, score=100, wordlength=12 to obtain nucleotide sequences homologous to a nucleic acid molecules of the invention. BLAST protein searches can be performed with the XBLAST program, score=50, wordlength=3 to obtain amino acid sequences homologous to a protein molecules of the invention. To obtain gapped alignments for comparison purposes, Gapped BLAST can be utilized as described in Altschul et al. (1997) *Nucleic Acids Res.* 25:3389-3402. Alternatively, PSI-Blast can be used to perform an iterated search which detects distant relationships between molecules. Id. When utilizing BLAST, Gapped BLAST, and PSI-Blast programs, the default parameters of the respective programs (e.g., XBLAST and NBLAST) can be used. Another preferred, non-limiting example of a mathematical algorithm utilized for the comparison of sequences is the algorithm of Myers and Miller, (1988) *CABIOS* 4:11-17. Such an algorithm is incorporated into the ALIGN program (version 2.0) which is part of the GCG sequence alignment software package. When utilizing the ALIGN program for comparing amino acid sequences, a PAM 120 weight residue table, a gap length penalty of 12, and a gap penalty of 4 can be used.

As used herein, the term "hybridizes under stringent conditions" is intended to describe conditions for hybridization and washing under which nucleotide sequences at least 60% (65%, 70%, preferably 75% or more) identical to each other typically remain hybridized to each other. Such stringent conditions are known to those skilled in the art and can be found in *Current Protocols in Molecular Biology*, John Wiley & Sons, N.Y. (1989), 6.3.1-6.3.6, which describes aqueous and non-aqueous methods, either of which can be used. Another preferred, non-limiting example of stringent hybridization conditions are hybridization in 6× sodium chloride/sodium citrate (SSC) at about 45° C., followed by one or more washes in 2.0×SSC at 50° C. (low stringency) or 0.2×SSC, 0.1% SDS at 50-65° C. (high stringency). Another preferred example of stringent hybridization conditions are hybridization in 6× sodium chloride/sodium citrate (SSC) at about 45° C., followed by one or more washes in 0.2×SSC, 0.1% SDS at 50° C. Another example of stringent hybridization conditions are hybridization in 6× sodium chloride/sodium citrate (SSC) at about 45° C., followed by one or more washes in 0.2×SSC, 0.1% SDS at 55° C. A further example of stringent hybridization conditions are hybridization 6× sodium chloride/sodium citrate (SSC) at about 45° C., followed by one or more washes in 0.2×SSC, 0.1% SDS at 60° C. Preferably, stringent hybridization conditions are hybridization in 6× sodium chloride/sodium citrate (SSC) at about 45° C., followed by one or more washes in 0.2×SSC, 0.1% SDS at 65° C. Particularly preferred stringency conditions (and the conditions that should be used if the practitioner is uncertain about what conditions should be applied to determine if a molecule is within a hybridization limitation of the invention) are 0.5M Sodium Phosphate, 7% SDS at 65° C., followed by one or more washes at 0.2×SSC, 1% SDS at 65° C. In one embodiment, an isolated nucleic acid molecule of the invention that hybridizes under stringent conditions to the sequence of SEQ ID NOs: 1, 3, 24, 26, 27, 29, 31, 33, 35, 37, 39, 41, 43 or 45, or complement thereof, corresponds to a naturally-occurring nucleic acid molecule.

The term "interact" as used herein is meant to include detectable interactions between molecules, such as can be detected using, for example, a yeast two hybrid assay. The term interact is also meant to include "binding" interactions between molecules. Interactions may be, e.g., protein-protein, protein-nucleic acid, protein-small molecule, or nucleic acid-small molecule in nature.

The term "modulation" as used herein refers to both upregulation, i.e., stimulation, and downregulation, e.g., suppression, of a response.

The term "mutated gene" refers to an allelic form of a gene, which is capable of altering the phenotype of a subject having the mutated gene relative to a subject which does not have the mutated gene. If a subject must be homozygous for this mutation to have an altered phenotype, the mutation is said to be recessive. If one copy of the mutated gene is sufficient to alter the genotype of the subject, the mutation is said to be dominant. If a subject has one copy of the mutated gene and has a phenotype that is intermediate between that of a homozygous and that of a heterozygous (for that gene) subject, the mutation is said to be co-dominant. As used herein, a "naturally-occurring" nucleic acid molecule refers to an RNA or DNA molecule having a nucleotide sequence that occurs in nature (e.g., encodes a natural protein).

The "non-human animals" of the invention include mammalians such as rodents, non-human primates, sheep, dog, cow, chickens, amphibians, reptiles, etc. Preferred non-human animals are selected from the rodent family including rat and mouse, most preferably mouse, though transgenic amphibians, such as members of the *Xenopus* genus, and transgenic chickens can also provide important tools for understanding and identifying agents which can affect, for example, embryogenesis and tissue formation. The term "chimeric animal" is used herein to refer to animals in which the recombinant gene is found, or in which the recombinant is expressed in some but not all cells of the animal. The term "tissue-specific chimeric animal" indicates that one of the recombinant Delta3 genes is present and/or expressed or disrupted in some tissues but not others.

As used herein, the term "nucleic acid molecule" is intended to include DNA molecules and RNA molecules (e.g., mRNA) and analogs of the DNA or RNA generated using nucleotide analogs. The nucleic acid molecule can be single-stranded or double-stranded, but preferably is double-stranded DNA. An "isolated" nucleic acid molecule is one which is separated from other nucleic acid molecules which are present in the natural source of the nucleic acid molecule. Preferably, an "isolated" nucleic acid molecule is free of sequences (preferably protein encoding sequences) which naturally flank the nucleic acid (i.e., sequences located at the 5' and 3' ends of the nucleic acid) in the genomic DNA of the organism from which the nucleic acid is derived. In other embodiments, the "isolated" nucleic acid is free of intron sequences. For example, in various embodiments, the isolated nucleic acid molecule preferably includes no more than 10 kilobases (kb), and more preferably, contains less than about 5 kB, 4 kB, 3 kB, 2 kB, 1 kB, 0.5 kB or 0.1 kB of nucleotide sequences which naturally flank the nucleic acid molecule in genomic DNA of the cell from which the nucleic acid is derived. Moreover, an "isolated" nucleic acid molecule, such as a cDNA molecule, can be substantially free of other cellular material, viral material, or culture medium when produced by recombinant techniques, or substantially free of chemical precursors or other chemicals when chemically synthesized.

The terms "protein", "polypeptide" and "peptide" are used interchangably herein. The term "substantially free of other cellular proteins" (also referred to herein as "contaminating proteins") or "substantially pure or purified preparations" are defined as encompassing preparations of Delta3 polypeptides having less than about 20% (by dry weight) contaminating protein, and preferably having less than about 5% contaminating protein. Functional forms of the subject polypeptides can be prepared, for the first time, as purified or isolated preparations by using a cloned gene as described herein. By "purified" or "isolated," it is meant, when referring to a protein of the invention, that the indicated molecule is present in the substantial absence of other biological macromolecules, such as other proteins. The term "purified" or "isolated" as used herein preferably means at least 80% by dry weight, more preferably in the range of 95-99% by weight, and most preferably at least 99.8% by weight, of biological macromolecules of the same type present (but water, buffers, and other small molecules, especially molecules having a molecular weight of less than about 5000, can be present). The term "pure" or "isolated" as used herein preferably has the same numerical limits as "purified" or "isolated" immediately above. "Isolated" and "purified" do not encompass either natural materials in their native state or natural materials that have been separated into components (e.g., in an acrylamide gel) but not obtained either as pure (e.g., lacking contaminating proteins, or chromatography reagents such as denaturing agents and polymers, e.g., acrylamide or agarose) substances or solutions. In preferred embodiments, purified or isolated Delta3 preparations will lack any contaminating proteins from the same animal from which Delta3 is normally produced, as can be accomplished by recombinant expression of, for example, a human Delta3 protein in a non-human cell.

As used herein, the term "tissue-specific promoter" means a DNA sequence that serves as a promoter, i.e., regulates expression of a selected DNA sequence operably linked to the promoter, and which effects expression of the selected DNA sequence in specific cells of a tissue, such as cells of cardiac, hepatic or pancreatic origin, neuronal cells, or immune cells. The term also covers so-called "leaky" promoters, which regulate expression of a selected DNA primarily in one tissue, but cause expression in other tissues as well.

"Transcriptional regulatory sequence" is a generic term used throughout the specification to refer to DNA sequences, such as initiation signals, enhancers, and promoters, which induce or control transcription of protein coding sequences with which they are operably linked. In certain embodiments, transcription of one of the recombinant Delta3 genes is under the control of a promoter sequence (or other transcriptional regulatory sequence) which controls the expression of the recombinant gene in a cell-type in which expression is intended. It will also be understood that the recombinant gene can be under the control of transcriptional regulatory sequences which are the same or which are different from those sequences which control transcription of the naturally-occurring forms of Delta3 proteins.

As used herein, the term "transfection" means the introduction of a nucleic acid, e.g., an expression vector, into a recipient cell by nucleic acid-mediated gene transfer. "Transformation", as used herein, refers to a process in which a cell's genotype is changed as a result of the cellular uptake of exogenous DNA or RNA, and, for example, the transformed cell expresses a recombinant form of a Delta3 polypeptide or, in the case of anti-sense expression from the transferred gene, the expression of a naturally-occurring form of the Delta3 protein is disrupted.

As used herein, the term "transgene" means a nucleic acid sequence (encoding, e.g., one of the Delta3 polypeptides, or an antisense transcript thereto), which is partly or entirely heterologous, i.e., foreign, to the transgenic animal or cell into which it is introduced, or, is homologous to an endogenous gene of the transgenic animal or cell into which it is introduced, but which is designed to be inserted, or is inserted, into the animal's genome in such a way as to alter the genome of the cell into which it is inserted (e.g., it is inserted at a location which differs from that of the natural gene or its insertion results in a knockout). A transgene can include one or more transcriptional regulatory sequences and any other nucleic acid, such as introns, that may be necessary for optimal expression of a selected nucleic acid.

A "transgenic animal" refers to any non-human animal, preferably a non-human mammal, bird or an amphibian, in which one or more of the cells of the animal contain heterologous nucleic acid ("transgene") introduced by way of human intervention, such as by transgenic techniques well known in the art. The nucleic acid is introduced into the cell, directly or indirectly by introduction into a precursor of the cell, by way of deliberate genetic manipulation, such as by microinjection or by infection with a recombinant virus. The term genetic manipulation does not include classical cross-breeding, or in vitro fertilization, but rather is directed to the introduction of a recombinant DNA molecule. This molecule may be integrated within a chromosome, or it may be extrachromosomally replicating DNA. In the typical transgenic animals described herein, the transgene causes cells to express a recombinant form of one of the Delta3 proteins, e.g., either agonistic or antagonistic forms. However, transgenic animals in which the recombinant Delta3 gene is silent are also contemplated, as for example, the FLP or CRE recombinase dependent constructs described below. Moreover, "transgenic animal" also includes those recombinant animals in which gene disruption of one or more Delta3 genes is caused by human intervention, including both recombination and antisense techniques. A "homologous recombinant animal" is a non-human animal, preferably a mammal, more preferably a mouse, in which an endogenous gene has been altered by homologous recombination between the endogenous gene and an exogenous DNA molecule introduced into a cell of the animal, e.g., an embryonic cell of the animal, prior to development of the animal.

As used herein, the term "vector" refers to a nucleic acid molecule capable of transporting another nucleic acid to which it has been linked. One type of preferred vector is an episome, i.e., a nucleic acid capable of extra-chromosomal replication. Preferred vectors are those capable of autonomous replication and/expression of nucleic acids to which they are linked. Vectors capable of directing the expression of genes to which they are operatively linked are referred to herein as "expression vectors". In general, expression vectors of utility in recombinant DNA techniques are often in the form of "plasmids" which refer generally to circular double stranded DNA loops which, in their vector form are not bound to the chromosome. However, the invention is intended to include such other forms of expression vectors which serve equivalent functions and which become known in the art subsequently hereto.

The term "treating" as used herein is intended to encompass curing as well as ameliorating at least one symptom of the condition or disease.

The percent identity between two sequences can be determined using techniques similar to those described above, with or without allowing gaps. In calculating percent identity, typically only exact matches are counted.

FTHMA-070 and T85

The present invention is based, in part, on the discovery of a cDNA molecule encoding human FTHMA-070, a member of the TNF receptor superfamily.

A nucleotide sequence encoding a human FTHMA-070 protein is shown in SEQ ID NO:53 and SEQ ID NO:55 (open reading frame only). A predicted amino acid sequence of FTHMA-070 protein is also shown in SEQ ID NO:54.

The FTHMA-070 cDNA of SEQ ID NO:53, which is approximately 2133 nucleotides long including untranslated regions, encodes a 401 amino acid protein.

Human FTHMA-070 is one member of a family of molecules (the "FTHMA-070 family") having certain conserved structural and functional features. The term "family" when referring to the protein and nucleic acid molecules of the invention is intended to mean two or more proteins or nucleic acid molecules having a common structural domain and having sufficient amino acid or nucleotide sequence identity as defined herein. Such family members can be naturally occurring and can be from either the same or different species. For example, a family can contain a first protein of human origin and a homologue of that protein of murine origin, as well as a second, distinct protein of human origin and a murine homologue of that protein. Members of a family may also have common functional characteristics.

As used interchangeably herein a "FTHMA-070 activity", "biological activity of FTHMA-070" or "functional activity of FTHMA-070", refers to an activity exerted by a FTHMA-070 protein, polypeptide or nucleic acid molecule on a FTHMA-070 responsive cell as determined in vivo, or in vitro, according to standard techniques. A FTHMA-070 activity can be a direct activity, such as an association with or an enzymatic activity on a second protein or an indirect activity.

Accordingly, another embodiment of the invention features isolated FTHMA-070 proteins and polypeptides having a FTHMA-070 activity.

Yet another embodiment of the invention features FTHMA-070 molecules which contain a signal sequence. Generally, a signal sequence (or signal peptide) is a peptide containing about 20 amino acids which occurs at the extreme N-terminal end of secretory and integral membrane proteins and which contains large numbers of hydrophobic amino acid residues and serves to direct a protein containing such a sequence to a lipid bilayer.

The present invention is also based, in part, on the discovery of a cDNA molecule encoding human T85, a protein which appears to be a secreted (non-membrane bound) form of human Robo protein, a protein which is a nerve axon guidance receptor.

A nucleotide sequence encoding a human T85 protein is shown in SEQ ID NO:57 and SEQ ID NO:59 (open reading frame only). A predicted amino acid sequence of FTMA-070 protein is also shown in SEQ ID NO:58.

The FTMA-070 cDNA of SEQ ID NO:57, which is approximately 4291 nucleotides long including untranslated regions, encodes a 753 amino acid protein. Human T85 is one member of a family of molecules (the "T85 family") having certain conserved structural and functional features. The term "family" when referring to the protein and nucleic acid molecules of the invention is intended to mean two or more proteins or nucleic acid molecules having a common structural domain and having sufficient amino acid or nucleotide sequence identity as defined herein. Such family members can be naturally occurring and can be from either the same or different species. For example, a family can contain a first protein of human origin and a homologue of that protein of murine origin, as well as a second, distinct protein of human origin and a murine homologue of that protein. Members of a family may also have common functional characteristics.

In one embodiment, a T85 protein includes a fibronectin type III domain having at least about 65%, preferably at least about 75%, and more preferably about 85%, 95%, or 98% amino acid sequence identity to a fibronectin type III domain of SEQ ID NO:61, or 62.

In one embodiment, a T85 protein includes an Ig superfamily domain having at least about 65%, preferably at least about 75%, and more preferably about 85%, 95%, or 98% amino acid sequence identity to an Ig superfamily domain of SEQ ID NO:63, 64, 65, 66, or 67.

Preferred T85 polypeptides of the present invention have an amino acid sequence sufficiently identical to a sequence identity to a fibronectin type III domain of SEQ ID NO:61 or 62 or an Ig superfamily domain of SEQ ID NO:63, 64, 65, 66, or 67. As used herein, the term "sufficiently identical" refers to a first amino acid or nucleotide sequence which contains a sufficient or minimum number of identical or equivalent (e.g., an amino acid residue which has a similar side chain) amino acid residues or nucleotides to a second amino acid or nucleotide sequence such that the first and second amino acid or nucleotide sequences have a common structural domain and/or common functional activity. For example, amino acid or nucleotide sequences which contain a common structural domain having about 65% identity, preferably 75% identity, more preferably 85%, 95%, or 98% identity are defined herein as sufficiently identical.

As used interchangeably herein a "T85 activity", "biological activity of T85" or "functional activity of T85", refers to an activity exerted by a T85 protein, polypeptide or nucleic acid molecule on a T85 responsive cell as determined in vivo, or in vitro, according to standard techniques. A T85 activity can be a direct activity, such as an association with or an enzymatic activity on a second protein.

Accordingly, another embodiment of the invention features isolated T85 proteins and polypeptides having a T85 activity.

Yet another embodiment of the invention features T85 molecules which contain a signal sequence. Generally, a signal sequence (or signal peptide) is a peptide containing about 20 amino acids which occurs at the extreme N-terminal end of secretory and integral membrane proteins and which contains large numbers of hydrophobic amino acid residues and serves to direct a protein containing such a sequence to a lipid bilayer.

Tango 77

The polypeptide cytokine interleukin-1 (IL-1) is a critical mediator of inflammatory and overall immune response. To date, three members of the IL-1 family, IL-1α, IL-1β and IL-1ra (Interleukin-1 receptor antagonist) have been isolated and cloned. IL-1α and IL-1β are proinflammatory cytokines which elicit biological responses, whereas IL-1ra is an antagonist of IL-1α and IL-1β activity. Two distinct cell-surface receptors have been identified for these ligands, the type 1 IL-1 receptor (IL-1 RtI) and type II IL-1 receptor (IL-1 RtI). Recent results suggest that the IL-1 RtI is the receptor responsible for transducing a signal and producing biological effects.

While inflammation is an important homeostatic mechanism, aberrant inflammation has the potential for inducing damage to the host. Elevated IL-1 levels are known to be associated with a number of diseases particularly autoimmune diseases and inflammatory disorders. Since II-1ra is a naturally occurring inhibitor of IL-1, IL-1ra can be used to limit the aberrant and potentially deleterious effects of IL-1. In experimental animals, pretreatment with IL-1ra has been shown to prevent death resulting from lipopolysaccharide-induced sepsis. The relative absence of IL-1ra has also been suggested to play a role in human inflammatory bowel disease.

The present invention is based on the discovery of a cDNA molecule encoding human Tango-77, a member of the cytokine superfamily. The cDNA molecule encoding human Tango-77 has three possible open reading frames. The three possible nucleotide open reading frames for human Tango-77 protein are shown in SEQ ID NO:73, SEQ ID NO:76 and SEQ ID NO:80. The predicted amino acid sequence for the three possible Tango-77 immature proteins are shown in SEQ ID NO:72, SEQ ID NO:77 or SEQ ID NO:81 and three possible mature proteins are shown in SEQ ID NO:75, SEQ ID NO:79 and SEQ ID NO:83.

The Tango-77 cDNA of SEQ ID NO:71, which is approximately 989 nucleotides long including untranslated regions, encodes a protein amino acid having a molecular weight of approximately 19 kDa, 18 kDa, or 14.9 KDa (excluding post-translational modifications) and the possible mature form of the protein has a molecular weight of 13 kDa. A plasmid containing a cDNA encoding human Tango-77 (with the cDNA insert name of Of fthx077) was deposited with American Type Culture Collection (ATCC), 10801 University Boulevard, Manassas, Va. 20110-2209 on Jul. 2, 1998 and assigned Accession Number 98807. This deposit will be maintained under the terms of the Budapest Treaty on the International Recognition of the Deposit of Microorganisms for the Purposes of Patent Procedure. This deposit was made merely as a convenience for those of skill in the art and is not an admission that a deposit is required under 35 U.S.C. §112.

Human Tango-77 is one member of a family of molecules (the "Tango-77 family") having certain conserved structural and functional features. The term "family," when referring to the protein and nucleic acid molecules of the invention, is intended to mean two or more proteins or nucleic acid molecules having a common structural domain and having sufficient amino acid or nucleotide sequence identity as defined herein. Such family members can be naturally occurring and can be from either the same or different species. For example, a family can contain a first protein of human origin and a homologue of that protein of murine origin, as well as a second, distinct protein of human origin and a murine homologue of that protein. Members of a family may also have common functional characteristics.

As used interchangeably herein a "Tango-77 activity", "biological activity of Tango-77" or "functional activity of Tango-77", refers to an activity exerted by a Tango-77 protein, polypeptide or nucleic acid molecule on a Tango-77 responsive cell as determined in vivo, or in vitro, according to standard techniques. A Tango-77 activity can be a direct activity, such as an association with a second protein, or an indirect activity, such as a cellular signaling activity mediated by interaction of the Tango-77 protein with a second protein. In a preferred embodiment, a Tango-77 activity includes at least one or more of the following activities: (i) the ability to interact with proteins in the Tango-77 signalling pathway (ii) the ability to interact with a Tango-77 ligand or receptor; or (iii) the ability to interact with an intracellular target protein, (iv) the ability to interact with a protein involved in inflammation, and (v) the ability to bind the IL-1 receptor.

Accordingly, another embodiment of the invention features isolated Tango-77 proteins and polypeptides having a Tango-77 activity.

Yet another embodiment of the invention features Tango-77 molecules which contain a signal sequence. Generally, a signal sequence (or signal peptide) is a peptide containing about 21 to 63 amino acids which occurs at the extreme N-terminal end of a secretory protein. The native Tango-77 signal sequence (SEQ ID NO:74, SEQ ID NO:78, or SEQ ID NO:82) can be removed and replaced with a signal sequence from another protein. In certain host cells (e.g., mammalian host cells), expression and/or secretion of Tango-77 can be increased through use of a heterologous signal sequence. For example, the gp67 secretory sequence of the baculovirus envelope protein can be used as a heterologous signal sequence. Alternatively, the native Tango-77 signal sequence can itself be used as a heterologous signal sequence in expression systems, e.g., to facilitate the secretion of a protein of interest.

SPOIL

Interleukin-1 (IL-1) is a multifunctional cytokine which comprises a family of two polypeptides, IL-1a and IL-1, with a wide spectrum of activities. IL-1α and IL-1β have been found to possess inflammatory, metabolic, physiologic, hematopoeitic and immunologic properties. Although both forms of IL-1 are distinct gene products, they recognize the same cell surface receptors (i.e. IL-1 receptors, IL-1RtI and IL-1RtII).

Besides skin keratinocytes, some epithelial cells and certain cells in the central nervous system, significant amounts of mRNA encoding IL-1 are not observed in most other healthy cells. However, IL-1 production is dramatically increased by a variety of cells in response to infection, microbial toxins, inflammatory agents, products of activated lymphocytes, complement and clotting components. In addition, IL-1 has been recognized as a prototype of proinflammatory cytokines in that it induces the expression of a variety of genes and the synthesis of several proteins that in turn, induce acute and chronic inflammation. Thus, circulating IL-1 has been implicated in various disease states including sepsis, rheumatoid arthritis, stroke and diabetes. Dinarello (1991) *Blood* 77(8): 1627-1652.

In addition, IL-1 has been shown to regulate bone reabsorption and bone formation with its major activity in bone metabolism being osteoclast activation. See Gowen et al. (1983) *Nature* 306:378-380. In fact, IL-1 has been reported to be a potent stimulator of bone reabsorption and has also been reported to increase prostaglandin synthesis in bone. Lorenzo et al. (1987) *Endocrinology* 121:1164-1170.

A naturally-occurring, secreted inhibitor of IL-1 which specifically inhibits IL-1 activity has also been identified. Carter et al. (1990) *Nature* 344:633. This protein, called IL-1 receptor antagonist protein (IL-1ra), has been shown to compete with the binding of IL-1 to its surface receptors. Thus, significant interest has arisen in administering IL-1ra to block the activity of IL-1 in various diseases including septic shock (Ohlsson et al. (1990) *Nature* 348:550-556), immune complex-induced colitis (Cominelli (1990) *J. Clin. Invest.* 86:972-979), acute myelogenous leukemia (Rambaldi et al. (1990) *Blood* 76:114-120) and osteoporosis (Pacifici et al. (1993) *J. Clin. Endocrinol. Metab.* 77:1135-1141). Further research has indicated that the secreted form of IL-1ra is, in fact, a member of a family of IL-1ra proteins, at least three of which are intracellular proteins (Haskill et al. (1991) *Proc. Natl. Acad. Sci. USA* 88:3681-3685; Muzio et al. (1995) *J. Exp. Med.* 182:623-628; and Weissbach et al. (1998) *Biochem. Biophys. Res. Comm.* 244:91-95. The family members are alternatively spliced isoforms of the IL-ra gene which consists of at least seven exons. A truncated form of the fourth exon is produced as a result of an internal splice acceptor site, resulting in the secreted isoform.

The present invention is based on the discovery of novel molecules having homology to members of the IL-1 receptor antagonist (IL-1ra) family, referred to herein as SPOIL protein and nucleic acid molecules. The SPOIL proteins and nucleic acid molecules comprise a family of molecules having certain conserved structural and functional features. The term "family" when referring to the protein and nucleic acid molecules of the invention is intended to mean two or more protein or nucleic acid molecules having a common structural domain and having sufficient amino acid or nucleotide sequence identity as defined herein. Such family members can be naturally occurring and can be from either the same or different species. For example, a family can contain a first protein of human origin, as well as other, distinct proteins of human origin or alternatively, can contain homologues of non-human origin (e.g., mouse). Members of a family may also have common functional characteristics.

For example, an isolated protein of the invention, preferably a SPOIL protein, is identified based on the presence of at least one "IL-1 signature domain" in the protein or corresponding nucleic acid molecule. As used herein, the term "IL-1 signature domain" refers to a protein domain which contains a conserved motif of a SPOIL protein member (or IL-1ra or IL-1 family member) and is at least about 10-30 amino acid residues, preferably about 15-25 amino acid residues, more preferably about 17-24 amino acid residues, more preferably 19-23 amino acid residues, and more preferably 21-22 amino acid residues in length. An IL-1 signature domain includes the following amino acid motif: $Xaa_1$-$Xaa_2$-S-$Xaa_3$-$Xaa_4$-$Xaa_5$-P-$Xaa_6$-$Xaa_7$-$Xaa_8$-$Xaa_9$-$Xaa_{10}$-$Xaa_n$-$Xaa_{11}$, wherein $Xaa_1$; $Xaa_2$, $Xaa_4$, $Xaa_5$, $Xaa_6$, $Xaa_7$, and $Xaa_n$ represents any amino acid residue; $Xaa_3$ is alanine (A), serine (S), leucine (L) or valine (V); $Xaa_8$ is phenylalanine (F), tyrosine (Y), leucine (L), isoleucine (I) or valine (V); $Xaa_9$ is either leucine (L) or isoleucine (I); $Xaa_{10}$ is serine (S), cysteine (C) or alanine (A); $Xaa_{11}$ is leucine (L), isoleucine (I), valine (V) or methionine (M); and n is about 5-25 amino acid residues, more preferably about 6-18 amino acid residues, and more preferably about 6-15 amino acid residues (SEQ ID NO:107). In one embodiment, an IL-1 signature domain includes the following amino acid motif: L-$Xaa_1$_S—V-$Xaa_2$-$Xaa_3$-P-$Xaa_4$-$Xaa_5$-$Xaa_n$-I, wherein Xaa represents any amino acid, and n is about 5-25 amino acid residues, more preferably about 6-18 amino acid residues, and more preferably about 6-15 amino acid residues (SEQ ID NO:108). Preferably, the IL-1 signature domain includes the following amino acid sequence: L-$Xaa_1$-S-V-$Xaa_2$-$Xaa_3$-P-$Xaa_4$-$Xaa_5$-$Xaa_n$-I, wherein $Xaa_1$ is either threonine (T) or glutamic acid (E); $Xaa_2$ is either alanine (A) or glutamic acid (E); and $Xaa_5$ is either tryptophan (W) or leucine (L) (SEQ ID NO:111). In another embodiment, an IL-1 signature domain includes the following amino acid sequence motif: F-$Xaa_1$-S-A-$Xaa_2$-$Xaa_3$-P-$Xaa_4$-$Xaa_5$-$Xaa_n$-L, wherein Xaa represents any amino acid, and n is about 5-25 amino acid residues, more preferably about 6-18 amino acid residues, and more preferably about 6-15 amino acid residues (SEQ ID NO:94). Preferably, the IL-1 signature domain includes the following amino acid sequence: F-$Xaa_1$-S-A-$Xaa_2$-$Xaa_3$-P-$Xaa_4$-$Xaa_5$-$Xaa_n$-L, wherein $Xaa_1$ is either threonine (T) or glutamic acid (E); $Xaa_2$ is either alanine (A) or glutamic acid (E); and $Xaa_5$ is either tryptophan (W) or leucine (L) (SEQ ID NO:95). In yet another embodiment, the IL-1 signature domain is at least about 10-30 amino acid residues in length, preferably 15-25 amino acid residues in length, preferably 17-24 amino acid residues, 19-23 amino acid residues or more preferably 21-22 amino acid residues in length and has at least about 30-60% identity, preferably at least about 35-55% identity, more preferably at least about 40-50% identity, and more preferably at least about 46-49% identity with an IL-1 signature domain of a protein of the invention having an amino acid sequence as set forth in SEQ ID NO:90 (e.g., amino acid residues 58-80), SEQ ID NO:102 (e.g., amino acid residues 130-151), SEQ ID NO:105 (e.g., amino acid residues 169-190), or SEQ ID NO:113 (e.g., amino acid residues 120-142).

In a preferred embodiment, a protein of the invention, preferably a SPOIL protein, contains an IL-1 signature domain of SEQ ID NO:90 (e.g., amino acid residues 58-80), SEQ ID NO:102 (e.g., amino acid residues 130-151), SEQ ID NO:105 (e.g., amino acid residues 169-190), or SEQ ID NO:113 (e.g., amino acid residues 120-142).

In another embodiment of the invention, a SPOIL protein is identified based on the presence of at least one "SPOIL signature motif" in the protein or corresponding nucleic acid molecule. As used herein, the term "SPOIL signature motif" includes an amino acid sequence which contains amino acid residues that are conserved among SPOIL family members. In one embodiment, a SPOIL signature motif, referred to herein as a "short SPOIL signature motif", includes an amino acid sequence at least about 35-55 amino acid residues, preferably about 38-50 amino acid residues, more preferably about 40-48 amino acid residues, more preferably 42-46 amino acid residues, and more preferably 44 amino acid residues in length and having the following amino acid sequence: Q-$Xaa_1$-$Xaa_2$-E-$Xaa_3$-$Xaa_4$-1-M-$Xaa_5$-$Xaa_6$-Y-$Xaa_7$-$Xaa_8$-$Xaa_9$-E-P—V-K-$Xaa_{10}$-$Xaa_{11}$-L-F—Y-$Xaa_{12}$-$Xaa_{13}$-K-$Xaa_{14}$-G-$Xaa_{15}$-T-S-T-$Xaa_{16}$-E-S-$Xaa_{17}$-A-F—P-$Xaa_{18}$-W-F-1-A, wherein $Xaa_{1-18}$ is any amino acid (set forth in SEQ ID NO:109). Accordingly, preferred proteins include the conserved amino acid residues of the above-recited SPOIL signature motif. Proteins including at least 30, 31, 32, 33, 34, 35, 36, 37, 38, 39, 40, 41, 42, or 43 conserved amino acid residues of the above-recited SPOIL signature motif are also considered to be within the scope of the present invention.

In another embodiment, a SPOIL signature motif, referred to herein as a "long SPOIL signature motif" includes an amino acid sequence of at least about 58-78 amino acid residues, preferably about 61-74 amino acid residues, more preferably about 63-72 amino acid residues, more preferably 65-70 amino acid residues, and more preferably 67-68 amino acid residues in length and having the following amino acid sequence: Q-$Xaa_1$-$Xaa_2$-E-$Xaa_3$-$Xaa_4$-I-M-$Xaa_5$-$Xaa_6$-Y-$Xaa_7$-$Xaa_8$-$Xaa_9$-E-P—V-K-$Xaa_{10}$-$Xaa_{11}$-L-F—Y-$Xaa_{12}$-$Xaa_{13}$-K-$Xaa_{14}$-G-$Xaa_{15}$-T-S-T-$Xaa_{16}$-E-S-$Xaa_{17}$-A-F—P-$Xaa_{18}$-W—F-1-A-$Xaa_{19}$-$Xaa_{20}$-$Xaa_{21}$-$Xaa_{22}$-$Xaa_{23}$-$Xaa_{24}$-$Xaa_{25}$-P-$Xaa_{26}$-1-L-T-$Xaa_{27}$-E-L-G-$Xaa_{28}$-$Xaa_{29}$-$Xaa_{30}$-$Xaa_{31}$-T-$Xaa_{32}$-F-E, wherein $Xaa_{1-24}$ and 26-32 is any amino acid $Xaa_{25}$ is no amino acid or any amino acid (set forth in SEQ ID NO:110). A preferred protein includes the conserved amino acid residues of the above-recited SPOIL signature motif. Proteins including at least 56, 57, 58, 59, 60, 61, 62, 63, 64, 65, or 66 conserved amino acid residues of the above-recited SPOIL signature motif are also considered to be within the scope of the present invention.

Table III depicts the conserved amino acid residues of the SPOIL signature motifs set forth in SEQ ID NO:109 and SEQ ID NO:110. The conserved amino acid residues are numbered according to their position in the SPOIL signature motif as well as by their relative amino acid position in each of murine SPOIL-I, murine SPOIL-II, human SPOIL-I and human SPOIL-II. As used herein, the amino acid residues in each of the SPOIL proteins "correspond to" the relative amino acid residues in a SPOIL signature motif.

TABLE III

| Residue in SPOIL signature motif | corresponding residue in muSPOIL-I | corresponding residue in muSPOIL-II | corresponding residue in huSPOIL-I | corresponding residue in huSPOIL-II |
|---|---|---|---|---|
| Gln1 | Gln26 | Gln88 | Gln98 | Gln137 |
| Glu4 | Glu29 | Glu91 | Glu101 | Glu140 |
| Ile7 | Ile32 | Ile94 | Ile104 | Ile143 |
| Met8 | Met33 | Met95 | Met105 | Met144 |
| Tyr11 | Tyr36 | Tyr98 | Tyr108 | Tyr147 |
| Glu15 | Glu40 | Glu102 | Glu112 | Glu151 |
| Pro16 | Pro41 | Pro103 | Pro113 | Pro152 |
| Val17 | Val42 | Val104 | Val114 | Val153 |
| Lys18 | Lys43 | Lys105 | Lys115 | Lys154 |
| Leu21 | Leu46 | Leu108 | Leu118 | Leu157 |
| Phe22 | Phe47 | Phe109 | Phe119 | Phe158 |
| Tyr23 | Tyr48 | Tyr110 | Tyr120 | Tyr159 |
| Lys26 | Lys51 | Lys113 | Lys123 | Lys162 |
| Gly28 | Gly53 | Gly115 | Gly125 | Gly164 |
| Thr30 | Thr55 | Thr117 | Thr127 | Thr166 |
| Ser31 | Ser56 | Ser118 | Ser128 | Ser167 |
| Thr32 | Thr57 | Thr119 | Thr129 | Thr168 |
| Glu34 | Glu59 | Glu121 | Glu131 | Glu170 |
| Ser35 | Ser60 | Ser122 | Ser132 | Ser171 |
| Ala37 | Ala62 | Ala124 | Ala134 | Ala173 |
| Phe38 | Phe63 | Phe125 | Phe135 | Phe174 |
| Pro39 | Pro64 | Pro126 | Pro136 | Pro175 |
| Trp41 | Trp66 | Trp128 | Trp138 | Trp177 |
| Phe42 | Phe67 | Phe129 | Phe139 | Phe178 |
| Ile43 | Ile68 | Ile130 | Ile140 | Ile179 |
| Ala44 | Ala69 | Ala131 | Ala141 | Ala180 |
| Pro51 | Pro77 | Pro139 | Pro148 | Pro187 |
| Ile53 | Ile79 | Ile141 | Ile150 | Ile189 |
| Leu54 | Leu80 | Leu142 | Leu151 | Leu190 |
| Thr55 | Thr81 | Thr143 | Thr152 | Thr191 |
| Glu57 | Glu83 | Glu145 | Glu154 | Glu193 |
| Leu58 | Leu84 | Leu146 | Leu155 | Leu194 |
| Gly59 | Gly85 | Gly147 | Gly156 | Gly195 |
| Thr64 | Thr90 | Thr152 | Thr161 | Thr200 |
| Phe66 | Phe92 | Phe154 | Phe163 | Phe202 |
| Glu67 | Glu93 | Glu155 | Glu164 | Glu203 |

Another embodiment of the invention features proteins having a "SPOIL unique domain". As used herein, a "SPOIL unique domain" is at least about 134-150 amino acid residues in length and has at least about 45-50% identity with amino acid residues 66-206 of SEQ ID NO:105. In another embodiment, the SPOIL unique domain is at least about 136-148 amino acid residues, preferably about 138-146 amino acid residues, more preferably 140-144 amino acid residues, and more preferably 141, 142, or 143 amino acid residues in length and has at least about 55-60%, preferably about 65-70%, and more preferably about 75%, 80%, 85%, 90%, 95%, 98%, 99%, or 100% identity with amino acid residues 66-206 of SEQ ID NO:105. In a preferred embodiment, the SPOIL unique domain is from about amino acid residues 66-206 of human SPOIL-II shown in SEQ ID NO:105. In another preferred embodiment, the SPOIL unique domain is from about amino acid residues 27-167 of human SPOIL-I shown in SEQ ID NO:102. In yet another preferred embodiment, the SPOIL unique domain is from about amino acid residues 17-158 of murine SPOIL-II shown in SEQ ID NO:113.

Another embodiment of the invention features proteins having a "SPOIL C-terminal unique domain". As used herein, a "SPOIL C-terminal unique domain" is at least about 58-78 amino acid residues in length and has at least about 45-50% identity with amino acid residues 137-203 of SEQ ID NO:105. In another embodiment, the SPOIL C-terminal unique domain is at least about 61-74 amino acid residues, preferably about 63-72 amino acid residues, more preferably 65-70 amino acid residues, and more preferably 67-68 amino acid residues in length and has about 55-60%, preferably about 65-70%, and more preferably about 75%, 80%, 85%, 90%, 95%, 98%, 99%, or 100% identity with amino acid residues 137-203 of SEQ ID NO:105. In one embodiment, the C-terminal unique domain is located within the C-terminal 70 amino acids of the full-length protein, preferably within the C-terminal 80 amino acid residues of the protein, more preferably within the C-terminal 90 amino acid residues of the protein, and even more preferably within the C-terminal 100, 120, 140, 160 or 180 amino acid residues of the full-length protein. In a preferred embodiment, the SPOIL C-terminal unique domain is from about amino acid residues 137-203 of human SPOIL-11 shown in SEQ ID NO:105. In another preferred embodiment, the SPOIL C-terminal unique domain is from about amino acid residues 98-164 of human SPOIL-I shown in SEQ ID NO:102. In another preferred embodiment, the SPOIL C-terminal unique domain is from about amino acid residues 26-93 of murine SPOIL-I shown in SEQ ID NO:90. In yet another preferred embodiment, the SPOIL C-terminal unique domain is from about amino acid residues 88-155 of murine SPOIL-II shown in SEQ ID NO:113.

Another embodiment of the invention features a protein of the invention, preferably a SPOIL protein, which contain a signal sequence. As used herein, a "signal sequence" refers to a peptide containing about 17 amino acids which occurs at the N-terminus of secretory proteins and which contains a large number of hydrophobic amino acid residues. For example, a signal sequence contains at least about 13-22 amino acid residues, preferably about 15-20 amino acid residues, more preferably about 16-19 amino acid residues, and more preferably about 17 amino acid residues, and has at least about 35-65%, preferably about 38-50%, and more preferably about 40-45% hydrophobic amino acid residues (e.g., Valine, Leucine, Isoleucine or Phenylalanine). Such a "signal sequence", also referred to in the art as a "signal peptide", serves to direct a protein containing such a sequence to a lipid bilayer. For example, in one embodiment, a SPOIL protein contains a signal sequence containing about amino acids 1-17 of SEQ ID NO:90.

In yet another embodiment, a protein of the invention, preferably a SPOIL protein, encodes a mature protein. As used herein, the term "mature protein" refers to a protein of the invention, preferably a SPOIL protein, from which the signal peptide has been cleaved. In an exemplary embodiment, a mature SPOIL protein contains amino acid residues 1 to 81 of SEQ ID NO:93. In a preferred embodiment, a SPOIL protein is a mature SPOIL protein which includes an IL-1 signature domain. In yet another embodiment, a SPOIL protein is a mature protein which includes a SPOIL signature motif and/or a SPOIL C-terminal unique domain.

Preferred proteins of the present invention, preferably SPOIL proteins, have an amino acid sequence sufficiently homologous to the amino acid sequence of SEQ ID NO:90; SEQ ID NO:93; SEQ ID NO:102, SEQ ID NO:105, SEQ ID NO:113, the amino acid sequence encoded by the DNA insert of the plasmid deposited with ATCC as Accession Number 98883, or the amino acid sequence encoded by the DNA insert of the plasmid deposited with ATCC as Accession Number 98984. As used herein, the term "sufficiently homologous" refers to a first amino acid or nucleotide sequence which contains a sufficient or minimum number of identical or equivalent (e.g., an amino acid residue which has a similar side chain) amino acid residues or nucleotides to a second amino acid or nucleotide sequence such that the first and second amino acid or nucleotide sequences share common structural domains or motifs and/or a common functional activity. For example, amino acid or nucleotide sequences which share common structural domains have at least 45% or 50% identity, preferably 60% identity, more preferably 70%-80%, and even more preferably 90-95% identity across the amino acid sequences of the domains and contain at least one and preferably two structural domains or motifs, are defined herein as sufficiently homologous. Furthermore, amino acid or nucleotide sequences which share at least 45% or 50%, preferably 60%, more preferably 70-80%, or 90-95% identity and share a common functional activity are defined herein as sufficiently homologous.

As used interchangeably herein a "SPOIL activity", "biological activity of SPOIL" or "functional activity of SPOIL", refers to an activity exerted by a SPOIL protein, polypeptide or nucleic acid molecule on a SPOIL responsive cell as determined in vivo, or in vitro, according to standard techniques. In one embodiment, a SPOIL activity is a direct activity, such as an association with a target protein, preferably a SPOIL target molecule (e.g., a cell-surface or internalized IL-1 or SPOIL receptor). In another embodiment, a SPOIL activity is an indirect activity, such as inhibiting the synthesis or activity of a second protein (e.g., a protein of a signal pathway). In a preferred embodiment, a SPOIL activity is at least one or more of the following activities: (i) interaction of a SPOIL protein in the extracellular milieu with a protein molecule on the surface of the same cell which secreted the SPOIL protein molecule (e.g., a SPOIL receptor or IL-1 receptor); (ii) interaction of a SPOIL protein in the extracellular milieu with a protein molecule on the surface of a different cell from that which secreted the SPOIL protein molecule (e.g., a SPOIL receptor or IL-1 receptor); (iii) complex formation between a SPOIL protein and a cell-surface receptor; (iv) interaction of a SPOIL protein with a target molecule in the extracellular milieu (e.g., a soluble target molecule); (v) interaction of the SPOIL protein with an intracellular target molecule (e.g., interaction with an internalized or endocytosed receptor or ligand-coupled receptor); and (vi) complex formation with at least one, preferably two or more, intracellular target molecules.

In yet another preferred embodiment, a SPOIL activity is at least one or more of the following activities: (1) modulating, for example, antagonizing a signal transduction pathway (e.g., an IL-1-dependent or SPOIL-dependent pathway; (2) modulating cytokine production and/or secretion (e.g., production and/or secretion of a proinflammatory cytokine); (3) modulating lymphokine production and/or secretion; (4) modulating production of adhesion molecules and/or cellular adhesion; (5) modulating expression or activity of nuclear transcription factors; (6) modulating secretion of IL-1; (7) competing with IL-1 to bind an IL-1 receptor; (8) competing with a SPOIL protein (e.g., a SPOIL-I or SPOIL-II family member) to bind a SPOIL receptor; (9) modulating nuclear translocation of internalized IL-1 or SPOIL receptor or ligand-complexed receptor; (10) modulating cell proliferation, development or differentiation, for example, IL-1-stimulated or a SPOIL protein-stimulated proliferation, development or differentiation (e.g., of an epithelial cell, for example, a squamous epithelial cell of the esophagus, or of a skin cell, e.g., a keratinocyte); (11) modulating cell proliferation, development or differentiation of an osteogenic cell (e.g., of an osteoclast precursor cell, osteoclast and/or osteoblast); (12) modulating function of an osteogenic cell (e.g., osteoblast and/or osteoclast function); (13) modulating bone formation, bone metabolism and/or bone homeostasis (e.g., inhibiting bone resorption); (14) modulating cellular immune responses; (15) modulating cytokine-mediated proinflammatory actions (e.g., inhibiting acute phase protein synthesis by hepatocytes, fever, and/or prostaglandin synthesis, for example $PGE_2$ synthesis); and (16) promoting and/or potentiating wound healing.

The present invention is based, at least in part, on the discovery of a family of SPOIL proteins (e.g., SPOIL-I and SPOIL-II proteins) sharing certain conserved structural features (e.g., a SPOIL signature motif, an IL-1 signature domain, a SPOIL C-terminal unique domain). Moreover, it has been discovered that SPOIL proteins exist as multiple isoforms, presumably due to alternative splicing of one or more common genes. For example, SPOIL proteins having internal inserted amino acid segments have been identified (e.g., human SPOIL-II includes a segment of at least 40 amino acid residues not appearing in human SPOIL-I). SPOIL proteins have also been identified which may function as both secreted and intracellular molecules (e.g., murine SPOIL-I has a signal sequence which is not found in murine SPOIL-II). Therefore, additional SPOIL family members can be identified based on the nucleotide and amino acid sequence information provided herein which, e.g., via alternative splicing of genomic SPOIL sequences, have unique combinations of the structural features defined herein. For example, secreted isoforms of human SPOIL can be identified which include all, or a portion of the amino acid sequences set forth as SEQ ID NOs:102 and 105.

Moreover, SPOIL family members can be identified based on unique nucleotide and/or amino acid sequences found in one SPOIL family member as compared to a second SPOIL family member. For example, a comparison between the nucleotide sequences of murine SPOIL-I (SEQ ID NO:89) and murine SPOIL-II (SEQ ID NO:112) reveals that murine SPOIL-II includes a fragment from nucleotides 225 to 364 that is absent from murine SPOIL-I (SEQ ID NO:89). Moreover, a comparison of the amino acid sequences of murine SPOIL-I (SEQ ID NO:90) and murine SPOIL-11 (SEQ ID NO:113) reveals that murine SPOIL-II includes a fragment from amino acids 1 to 90 that is absent from murine SPOIL-I. Accordingly, one embodiment of the present invention includes an isolated nucleic acid molecule including nucleotides 225 to 364 of SEQ ID NO:112. In another embodiment, an isolated nucleic acid molecule of the present invention includes at least 30 contiguous nucleotides of SEQ ID NO:112 from nucleotides 225 to 364. In another embodiment, an isolated nucleic acid molecule of the present invention includes at least 20-140, 30-130, 40-120, 50-110, 60-100, 70, 80, or 90 contiguous nucleotides of SEQ ID NO:112 from nucleotides 225 to 364. In yet another embodiment, an isolated nucleic acid molecule of the present invention has at least about 50% identity to nucleotides 225 to 364 of SEQ ID NO:112. In yet another embodiment, an isolated nucleic acid molecule has at least 50% identity to at least 30 contiguous nucleotides of SEQ ID NO:112 from nucleotides 224 to 364. In yet another embodiment, an isolated nucleic acid molecule of the invention hybridizes under stringent conditions to nucleotides 225 to 364 of SEQ ID NO:112. In yet another embodiment, an isolated nucleic acid molecule hybridizes under stringent conditions to at least 30 contiguous nucleotides of SEQ ID NO:112 from nucleotides 225 to 364.

Another embodiment of the present invention pertains to a polypeptide including amino acids 1 to 90 of SEQ ID NO:113. In yet another embodiment, the polypeptide includes at least 30 contiguous amino acids of SEQ ID NO:113 from amino acids 1 to 90 of SEQ ID NO:113. In yet another embodiment, the polypeptide includes at least 10-90, 20-80, 30-70, 40, 50 or 60 contiguous amino acids of SEQ ID NO:113 from amino acids 1 to 90. Yet another embodiment of the invention pertains to a polypeptide having at least 50% identity to amino acids 1 to 90 of SEQ ID NO:113. In yet another embodiment, the polypeptide has at least 50% identity to at least 10-90, 20-80, 30-70, 40, 50 or 60 contiguous amino acids of SEQ ID NO:113 from amino acids 1 to 90. Yet another embodiment of the present invention features isolated nucleic acid molecules encoding any of the polypeptides described herein.

Likewise, a comparison between the nucleic acid sequences of human SPOIL-I (SEQ ID NO:101) and human SPOIL-II (SEQ ID NO:104) reveals that human SPOIL-II includes a fragment from nucleotides 153 to 269 that is absent from human SPOIL-I (SEQ ID NO:101). Moreover, a comparison of the amino acid sequences of human SPOIL-I (SEQ ID NO:102) and human SPOIL-H (SEQ ID NO:105) reveals that human SPOIL-II includes a fragment from amino acids 19 to 58 that is absent from human SPOIL-I. Accordingly, one embodiment of the present invention includes an isolated nucleic acid molecule including nucleotides 153 to 269 of SEQ ID NO:112. In another embodiment, an isolated nucleic acid molecule of the present invention includes at least 30 contiguous nucleotides of SEQ ID NO:112 from nucleotides 153 to 269. In another embodiment, an isolated nucleic acid molecule of the present invention includes at least 20-140, 30-130, 40-120, 50-110, 60-100, 70, 80, or 90 contiguous nucleotides of SEQ ID NO:104 from nucleotides 153 to 269. In yet another embodiment, an isolated nucleic acid molecule of the present invention has at least about 50% identity to nucleotides 153 to 269 of SEQ ID NO:104. In yet another embodiment, an isolated nucleic acid molecule has at least 50% identity to at least 30 contiguous nucleotides of SEQ ID NO: 104 from nucleotides 224 to 364. In yet another embodiment, an isolated nucleic acid molecule of the invention hybridizes under stringent conditions to nucleotides 153 to 269 of SEQ ID NO: 104. In yet another embodiment, an isolated nucleic acid molecule hybridizes under stringent conditions to at least 30 contiguous nucleotides of SEQ ID NO:104 from nucleotides 153 to 269.

Another embodiment of the present invention includes a polypeptide including amino acids 19 to 58 of SEQ ID NO:105. In yet another embodiment, the invention features a polypeptide which includes at least 30 contiguous amino acids of SEQ ID NO:105 from amino acids 19 to 58 of SEQ ID NO:105. In yet another embodiment, the polypeptide includes at least 10-90, 20-80, 30-70, 40, 50 or 60 contiguous amino acids of SEQ ID NO:105 from amino acids 19 to 58. In yet another embodiment, the polypeptide has at least 50% identity to amino acids 19 to 58 of SEQ ID NO:105. In yet another embodiment, the polypeptide has at least 50% identity to at least 10-90, 20-80, 30-70, 40, 50 or 60 contiguous amino acids of SEQ ID NO:105 from amino acids 19 to 58. Yet another embodiment of the present invention features isolated nucleic acid molecules encoding any of the polypeptides described herein.

Given the existence of both secreted and intracellular SPOIL molecules (e.g., SPOIL-I and II isoforms) described herein, it will be appreciated that the SPOIL molecules of the present invention and modulators of SPOIL proteins are useful, for example, in regulating cellular responses triggered by extracellular events (e.g., by interaction of, for example, a cytokine (e.g., IL-1) or a SPOIL protein with a cell surface receptor. For example, it is known that unbalanced production of IL-1 is associated with the pathogenesis of various inflammatory diseases. Accordingly, SPOIL proteins and/or SPOIL modulators may be useful as therapeutic agents in achieving homeostasis and ameliorating such imbalances.

Likewise, it will be appreciated that the SPOIL molecules of the present invention and modulators of SPOIL proteins are useful in regulating cytokine (e.g., IL-1) and/or SPOIL protein dependent intracellular responses (e.g., acting as intracellular antagonists or agonists). For example, it is known that cytokines (e.g., IL-1) are not secreted from certain cell types, for example, skin cells, e.g., keratinocytes, and accordingly, there exist a discreet subset of intracellular cytokine-dependent responses and a corresponding set of intracellular SPOIL protein-dependent activities.

Moreover, SPOIL molecules of the present invention have been found to be constitutively expressed, for example, in epithelial cells, in particular in the squamous epithelium of the esophagus and the epithelial lining of the mouth (e.g., murine SPOIL-II was isolated from an esophageal cDNA library). In addition, expression of SPOIL molecules can also be induced in certain cell types and tissues. For example, the human SPOILs were isolated from a stimulated keratinocyte library and human SPOIL-I was expressed in keratinocytes induced with PMA, ionomycin, TNF and cyclohexamide. In addition, human SPOIL-I was observed in monocytic cells stimulated with LPS and expression of SPOIL-I was induced in the kidneys of lippopolysaccharide (LPS)-injected mice. Furthermore, expression has been correlated with certain proliferative disorders. For example, human SPOIL-I was found to be expressed on human esophageal tumor samples and overexpressed in squamous cell carcinoma of the esophagus. It has further been demonstrated that a secreted form of SPOIL (e.g., murine SPOIL-I), when expressed in vivo, caused impairment of osteoclast differentiation and/or function as well as evidence of impaired bone resorption (see EXAMPLE 25).

Accordingly, in another embodiment of the invention, a SPOIL molecule or preferably, a SPOIL modulator, is useful for regulating, preventing and/or treating at least one or more of the following diseases or disorders: (1) inflammatory diseases and disorders including, but not limited to, inflammation, septic shock, arthritis, intercolitis, and pneumonitis; (2) epithelial cell and/or skin diseases and disorders including, but not limited to proliferative disorders (e.g., skin cancers including, but not limited to, melanoma, and Kaposi's sarcoma, and other epithelial cancers including squamous cell carcinoma, esophageal cancer and cancer of the mouth and/or throat); (3) bone-related and/or bone resorption disorders including, but not limited to osteoporosis, Paget's disease, osteoarthritis, degenerative arthritis, osteogenesis imperfecta, fibrous displasia, hypophosphatasia, bone sarcoma, myeloma bone disorder (e.g., osteolytic bone lesions) and hypercalcemia; and (4) diseases and disorders that involve the bowel and are characterized by the production of inflammation and at times, ulceration in the small or large bowel, including but not limited to, inflammatory bowel disease (IBD) (e.g., Crohn's disease, irritable bowel syndrome (IBS) and ulcerative colitis). Moreover, it will be appreciated that the SPOIL molecules and SPOIL modulators are useful for the following purposes: (1) regulation of bone mass (e.g., increase bone mass and/or inhibit bone loss); (2) management of bone fragility (e.g., decrease bone fragility); and (3) prevention and/or treatment of bone pain, bone deformities, and/or bone fractures.

Another embodiment of the invention features isolated SPOIL proteins and polypeptides having a conserved SPOIL structural feature and a SPOIL activity, as defined herein. Preferred SPOIL proteins have an IL-1 signature domain and a SPOIL activity. In one embodiment, the SPOIL protein has a signal peptide, an IL-1 signature domain, and a SPOIL activity. In another preferred embodiment, the SPOIL protein has a signal peptide, an IL-1 signature domain, a SPOIL activity, and an amino acid sequence sufficiently homologous to an amino acid sequence of SEQ ID NO:90; SEQ ID NO:102, SEQ ID NO:105, SEQ ID NO:113, the amino acid sequence encoded by the DNA insert of the plasmid deposited with ATCC as Accession Number 98883, or the amino acid sequence encoded by the DNA insert of the plasmid deposited with ATCC as Accession Number 98984.

Another embodiment of the invention features isolated SPOIL proteins and polypeptides having a SPOIL activity, a SPOIL signature motif (short or long form) and/or SPOIL unique domain. In another embodiment, the SPOIL protein has a SPOIL activity, a SPOIL signature motif (short or long form) and/or SPOIL C-terminal unique domain. In another preferred embodiment, the SPOIL protein has a SPOIL activity, a SPOIL signature motif (short or long form) and/or SPOIL C-terminal unique domain, and an amino acid sequence sufficiently homologous to an amino acid sequence of SEQ ID NO:90; SEQ ID NO:102, SEQ ID NO:105, SEQ ID NO:113, the amino acid sequence encoded by the DNA insert of the plasmid deposited with ATCC as Accession Number 98883, or the amino acid sequence encoded by the DNA insert of the plasmid deposited with ATCC as Accession Number 98984. The above-described SPOIL proteins can further include an IL-1 signature domain as described herein.

In a particularly preferred embodiment, the SPOIL protein and nucleic acid molecules of the present invention are human SPOIL molecules. A nucleotide sequence of the isolated human SPOIL-I cDNA and the predicted amino acid sequence of the human SPOIL-I protein are shown in SEQ ID NOs: 101 and 102, respectively. In addition, the nucleotide sequence corresponding to the coding region of the human SPOIL-I cDNA (nucleotides 124 to 630) is represented as SEQ ID NO: 103.

The human SPOIL-I cDNA, which is approximately 1291 nucleotides in length, encodes a protein which is approximately 169 amino acid residues in length. A plasmid containing the full length nucleotide sequence encoding human SPOIL-I (clone designation Epjthkf 035f11) was deposited under the provisions of the Budapest Treaty with the American Type Culture Collection (ATCC), presently in Manassas, Va., on Sep. 11, 1998 and assigned Accession Number 98883. The human SPOIL-I protein contains an IL-1 signature domain, which can be found, for example, from about amino acids 130 to 151 of SEQ ID NO:102 (Leu130 to Leu151 of the human SPOIL-I amino acid sequence). The human SPOIL-I protein further contains a SPOIL signature motif, which can be found, for example, from about amino acids 98-141 (short) of from about 98-164 (long) of SEQ ID NO:102 (Gln98 to Ala141 or Gln98 to Glu164 of the human SPOIL-I amino acid sequence). A SPOIL C-terminal unique domain can be found in the human SPOIL-I protein, for example, from about amino acid residues 98-164 of SEQ ID NO: 102 (Gln98 to Glu164 of the human SPOIL-I amino acid sequence).

A nucleotide sequence of the isolated human SPOIL-II cDNA and the predicted amino acid sequence of the human SPOIL-II protein are shown in SEQ ID NOs:106 and 107, respectively. In addition, the nucleotide sequence corresponding to the coding region of the human SPOIL-11 cDNA (nucleotides 98-721) is represented as SEQ ID NO:106.

The human SPOIL-II cDNA, which is approximately 1377 nucleotides in length, encodes a protein which is approximately 208 amino acid residues in length. A plasmid containing the full length nucleotide sequence encoding human SPOIL-II (clone designation Epjthkf 074e01) was deposited under the provisions of the Budapest Treaty with the American Type Culture Collection (ATCC), presently in Manassas, Va., on Nov. 11, 1998 and assigned Accession Number 98984. The human SPOIL-II protein contains an IL-1 signature domain, which can be found, for example, from about amino acids 169-190 of SEQ ID NO:102 (Leu169 to Leu190 of the human SPOIL-II amino acid sequence). The human SPOIL-II protein further contains a SPOIL signature motif, which can be found, for example, from about amino acids 137-180 (short) of from about 137-203 (long) of SEQ ID NO:105 (Gln137 to Ala180 or Gln137 to Glu203 of the human SPOIL-11 amino acid sequence). A SPOIL C-terminal unique domain can be found in the human SPOIL-11 protein, for example, from about amino acid residues 137-203 of SEQ ID NO:105 (Gln137 to Glu203 of the human SPOIL-II amino acid sequence), having 100% identity to the SPOIL C-terminal unique domain of human SPOIL-1.

In another embodiment, the SPOIL protein and nucleic acid molecules of the present invention are murine SPOIL molecules. A nucleotide sequence of the isolated murine SPOIL-1 cDNA and the predicted amino acid sequence of the murine SPOIL-I protein are shown in SEQ ID NOs:89 and 90, respectively. In addition, the nucleotide sequences corresponding to the coding region of the murine SPOIL-I cDNA (nucleotides 135-428) and the SPOIL-I cDNA encoding the mature SPOIL-I protein are represented as SEQ ID NO:91 and SEQ ID NO:92, respectively.

The murine SPOIL-I cDNA (set forth in SEQ ID NO:89), which is approximately 746 nucleotides in length, encodes a protein having a molecular weight of approximately 10.96 kD (with signal sequence) and 9.1 kD (without signal sequence) and which is approximately 98 amino acid residues in length (SEQ ID NO:90). The murine SPOIL-I protein contains an IL-1 signature domain as defined herein, which can be found, for example, from about amino acids 58 to 80 of SEQ ID NO:90 and, for example, from about amino acids 41-63 of SEQ ID NO:93. The murine SPOIL-1 protein further contains a SPOIL signature motif, which can be found, for example, from about amino acids 26-69 (short) of from about 26-93 (long) of SEQ ID NO:90 (Gln26 to Ala69 or Gln26 to Glu93 of the murine SPOIL-I amino acid sequence). A SPOIL C-terminal unique domain can be found in the murine SPOIL-I protein, for example, from about amino acid residues 26-93 of SEQ ID NO:105 (Gln26 to Glu93 of the murine SPOIL-I amino acid sequence), having 52.2% identity to the SPOIL C-terminal unique domain of human SPOIL-I. (Comparison can be made using, for example, the Lipman-Pearson Algorithm (Lipman and Pearson (1985) *Science* 227:1435-1441, with a K-tuple of 2, a Gap Penalty of 4, and a Gap Weight Penalty of 12. In addition, the murine SPOIL-I protein can contain a signal sequence. A signal sequence can be found at least, for example, from about amino acids 1-17 of SEQ ID NO:90. The prediction of such a signal peptide can be made, for example, utilizing the computer algorithm SignalP (Henrik, et al. (1997) *Protein Engineering* 10:1-6).

The entire amino acid sequence of SEQ ID NO:90 was subcloned into retroviral vector MSCVneo (Hawley, et al. (1994) *Gene Therapy* 1:136-138) and used for retroviral delivery. Bone marrow infected with the retroviral vector expressing murine SPOIL-I was transplanted into irradiated mice recipients. Bones removed from these mouse recipients, histologically, appeared thicker than the bones of control mice. In addition, spleen cells (i.e., a source of osteoclast progenitors) which were removed from mice recipients and were cultured on a bone marrow cell line, demonstrated reduced osteoclast production than the spleen cells of control mice. These experiments are discussed in further detail herein.

According to in situ analysis of mouse tissues, in the tissues tested, SPOIL-I mRNA transcript is expressed almost exclusively in the squamous cell epithelium of the esophagus and in the epithelial lining of the mouth. Northern blot analysis of human tissues confirms this pattern of SPOIL expression with transcripts being detected in esophagus with expression also likely in the trachea, among the tissues tested. In addition, SPOIL is also present on human esophageal tumor samples and overexpressed in moderately differentiated squamous cell carcinoma of the esophagus.

A multiple sequence alignment of the amino acid sequences of murine SPOIL-I with murine IL-1ra (Swiss-Prot™ Accession No. P25085) (SEQ ID NO:98), as well as murine IL-1α (Swiss-Prot™ Accession No. P01582) (SEQ ID NO:99) and murine IL-1β (Swiss-Prot™ Accession No. P10749) (SEQ ID NO:100) was generated using MegAlign™ sequence alignment software (refer to FIG. 2).

A nucleotide sequence of the isolated murine SPOIL-II cDNA and the predicted amino acid sequence of the murine SPOIL-II protein are shown in SEQ ID NOs: 112 and 113, respectively. In addition, the nucleotide sequences corresponding to the coding region of the murine SPOIL-II cDNA (nucleotides 96-575) is represented as SEQ ID NO:114.

The murine SPOIL-II cDNA (set forth in SEQ ID NO:112), which is approximately 838 nucleotides in length, encodes a protein which is approximately 160 amino acid residues in length (SEQ ID NO:113). The murine SPOIL-II protein contains an IL-1 signature domain as defined herein, which can be found, for example, from about amino acids 120 to 142 of SEQ ID NO:113. The murine SPOIL-II protein further contains a SPOIL signature motif, which can be found, for example, from about amino acids 88-131 (short) of from about 88-155 (long) of SEQ ID NO:113 (Gln88 to Ala131 or Gln88 to Glu155 of the murine SPOIL-II amino acid sequence). A SPOIL C-terminal unique domain can be found in the murine SPOIL-II protein, for example, from about amino acid residues 88-155 of SEQ ID NO:113 (Gln88 to Glu155 of the murine SPOIL-II amino acid sequence), having 52.2% identity to the SPOIL C-terminal unique domain of human SPOIL-I.

A multiple sequence alignment of the amino acid sequences of human SPOIL-I (corresponding to amino acid residues 1-169 of SEQ ID NO:102), human SPOIL-II (corresponding to amino acid residues 1-208 of SEQ ID NO:105), murine SPOIL-I (corresponding to amino acid residues 1-98 of SEQ ID NO:90), and murine SPOIL-II (corresponding to amino acid residues 1-160 of SEQ ID NO:113) is shown in FIG. 3.

A multiple sequence alignment of the amino acid sequences of murine SPOIL-I, murine SPOIL-II, human SPOIL-I, and human SPOIL-II with murine IL-1ra (Swiss-Prot™ Accession No. P25085) (SEQ ID NO:98), as well as murine IL-1a (Swiss-Prot™ Accession No. P01582) (SEQ ID NO:99) and murine IL-1β (Swiss-Prot™ Accession No. P10749) (SEQ ID NO:100) is shown in FIG. 4. (The alignments of FIGS. 2, 3, and 4 were generated using MegAlign™ sequence alignment software using the Clustal algorithm). The initial pairwise alignment parameters are set to a K-tuple of 1, a GAP penalty of 3, a window of 5, and diagonals saved set to =5. The multiple alignment parameters are set at a GAP penalty of 10, and a GAP length penalty of 10.)

NEOKINE

Cytokines are small peptide molecules produced by a variety of cells that mediate a wide range of biological activities. Arai et al. (1990) *Annu. Rev. Biochem.* 59:783 and Paul and Seder (1994) *Cell* 76:241. Through a complex network, cytokines regulate functions including cellular growth, inflammation, immunity, differentiation and repair. Mosmann (1991) *Curr. Opin. Immunol.* 3:311. One superfamily of cytokines, termed the chemokine superfamily, is a large group of more than 30 small proteins, many of which play a role in the selective recruitment and activation of leukocytes during inflammation. Wells and Peitsch (1997) *J. Leukoc. Biol.* 61:5. The chemokine superfamily can be subdivided into two groups based on the arrangement of the first two of four conserved cysteines, which are either separated by one amino acid (CXC chemokines) or adjacent (CC chemokines). Baggiolini et al. (1995) *Int. J. Immunopharmacol.* 17:2. IL-8 and the other CXC chemokines act preferentially on neutrophils, while the CC chemokines (MCP-1, MCP-2, MCP-3, RANTES, MIP-1 alpha and MIP-1 beta) act on monocytes, but not neutrophils, and have additional activities toward basophil and eosinophil granulocytes, and T-lymphocytes. Baggiolini et al., supra.

The CXC chemokine family of cytokines display disparate angiogenic activity depending upon the presence or absence of the ELR motif, a structural amino acid motif previously found to be important in receptor:ligand binding on neutrophils. CXC chemokines containing the ELR motif are potent angiogenic factors, inducing both in vitro endothelial chemotaxis and in vivo corneal neovascularization. In contrast, the CXC chemokines that lack the ELR motif including, PF4, IP-10, and MIG, not only fail to induce significant in vitro endothelial cell chemotaxis or in vivo corneal neovascularization, but are found to be potent angiostatic factors in the presence of CXC chemokines containing the ELR motif. Strieter et al. (1995) *Shock* 4:3. The CXC cytokines have a signature pattern which spans the region that includes the four conserved cysteine residues. A CXC-signature pattern has been generated from the consensus of multiple CXC chemokines. The signature pattern has been assigned Prosite Signature PS00471.

The present invention is based on the discovery of family of molecules, referred to herein as NEOKINE protein and nucleic acid molecules. The NEOKINEs are members of the non-ELR-CXC subfamily of chemokines (a shortening of chemoattractant cytokines). The CXC-chemokines display four highly conserved cysteine amino acid residues, with the first two cysteines separated by one non-conserved amino acid residue. The cloning of the NEOKINE family of CXC chemokines revealed at least three atypical features which distinguish them from previously characterized chemokines. These are (1) the presence of approximately 5 residues between the third and fourth conserved cysteine residues which are absent from other CXC chemokines; (2) the fewest residues preceeding the predicted amino terminus of the mature form of any naturally-occurring chemokine; and (3) a general dissimilarity to all other chemokines in the region between the second and third conserved cysteines. Phylogenetic analysis of known chemokines (e.g., known CXC as well as CC chemokines) further demonstrates that NEOKINE is unique from other chemokines subfamilies identified to date although it is clearly a related chemokine.

The family of NEOKINE chemokines described herein include human, murine, rat and macaque NEOKINE-1. Upon comparison of the sequences for each species orthologue, it was noticed that the NEOKINE-1 chemokines displayed a remarkable degree of identity between orthologues. For example, human NEOKINE-1 is 92% identical at the amino acid level to murine NEOKINE-1 (as determined using a Lipman-Pearson algorithm (Lipman and Pearson (1985) *Science* 227:1435-1441, Ktuple=2, Gap Penalty=4, Gap Length Penalty=12).

The present invention is also based on the discovery that NEOKINE is the surrogate ligand for a previously-identified orphan receptor known in the art as RDC1. RDC1 was first identified as one of four orphan receptors cloned from a dog thyroid cDNA library based on homology to the seven-transmembrane helice-containing G-protein coupled receptors (Libert et al. (1989) *Science* 244:569-572). Three of these, RDC4, RDC7, and RDC8 have since been identified as 5-HT$_{1D}$, adenosine A$_1$ and adenosine A$_2$ receptors, respectively (Maenhaut et al. (1991) *Biochem. Biophys. Res. Commun.* 173:1169-1178; Libert et al. (1991) *EMBO J.* 10:1677-1682; and Maenhaut et al. (1991) *Biochem. Biophys. Res. Commun.* 180:1460-1468). A human orthologue of the fourth orphan, termed GPRN1, was subsequently cloned which was initially proposed to be the receptor for vasoactive intestinal peptide ("VIP") (Sreedharan et al. (1991) *Proc. Natl. Acad. Sci. USA* 88:4986-4990). This finding has more recently been refuted (Nagata et al. (1992) *Trends Biochem. Sci.* 13:102-103; and Cook et al. (1992) *FEBS Lett.* 300:149-152), leaving the receptor orphaned. Recent reports have characterized the tissue expression of RDC1/GPRN1 receptor (Law and Rosenzweig (1994) *Biochem. Biophys. Res. Commun.* 201:458-465) and have identified and characterized a murine homologue of RDC1/GPRN1 (Heesen et al. (1998) *Immunogenetics* 47:364-370).

Sequence comparison of human and murine RDC1/GPRN1 reveals that these orthologues exhibit remarkable sequence identity as is the case with species orthologues of NEOKINE. Moreover, phylogenetic analysis of chemokine receptors demonstrates that RDC1/GPRN1 is a unique but distantly related member of the CXC subfamily of chemokine receptors. Given the remarkable sequence identity between species orthologues of NEOKINE and between orthologues of RDC1/GPRN1, as well as the unique positions which both NEOKINE and RDC1/GPRN1 fall on their respective phylogenetic trees, it has been determined that the NEOKINE is the surrogate ligand for the previously orphaned RDC1/GPRN1 receptor.

The term "family" when referring to the protein and nucleic acid molecules of the invention is intended to mean two or more proteins or nucleic acid molecules having a common structural domain and having sufficient amino acid or nucleotide sequence homology as defined herein. Such family members can be naturally occurring and can be from either the same or different species. For example, a family can contain a first protein of human origin, as well as other, distinct proteins of human origin or alternatively, can contain homologues of non-human origin. Members of a family may also have common functional characteristics.

In one embodiment, the NEOKINE proteins of the present invention are proteins having an amino acid sequence of about 75-125, preferably about 80-120, more preferably about 85-115, more preferably about 90-110, and even more preferably about 95-105 amino acids containing 3-7, preferably 5-6, and more preferably 4 cysteine residues which are conserved between family members. In another embodiment, a NEOKINE family member is identified based on the presence of at least one "NEOKINE CXC signature motif" in the protein or corresponding nucleic acid molecule. As used herein, the term "NEOKINE CXC signature motif" refers to a protein domain having an amino acid sequence of about 35-65, preferably about 40-60, more preferably about 45-55 amino acid residues, and even more preferably at least about 48-50 amino acids containing 3-7, preferably 5-6, and more preferably 4 cysteine residues which are conserved between family members, the first three residues of the NEOKINE CXC signature motif having the sequence C—X—C ("CXC"), wherein X is any amino acid and C is cysteine. In a preferred embodiment, a NEOKINE CXC signature motif has the pattern X (0-2)-C—X—C—X (20-24)-C—X (17-24)-C—X (0-2) (SEQ ID NO:185), wherein X is any amino acid and C is cysteine. In another preferred embodiment, a NEOKINE CXC signature motif has the pattern X (0-2)-C—X—C—X (23, 24)—C—X (20, 21)—C—X (2) (SEQ ID NO:186), wherein X is any amino acid and C is cysteine. In another preferred embodiment, a NEOKINE CXC signature motif has the pattern X (0-2)-C—X—C—X (6,7)-[LIVMFY]—X (2)-[RKSEQ]-X-[LIVM]-X (2)-[LIVM]-X (8) —C—X (4)-[LIVM] (2) —X (13,14)—C—[LWM]-X (SEQ ID NO:187). In another preferred embodiment, a NEOKINE CXC signature motif has the pattern X (0, 1)-[RK]—C—[RK]—C—X(4)-P—X(4, 5)-[ED]-X(6)-[KR]—X(5)-C—[DE](2) —X-[LIVMFY](4) —X (12,13)—H—C—[LIVM]-H (SEQ ID NO:188). The motifs described herein, are described according to standard Prosite Signature designation (e.g., X (0-2) designates any amino acid, n=0-2; X (6, 7) designates any amino acid, n=6 or 7; and [LIVM] indicates any one of Leu, Ile, Val, or Met. All amino acids are described using universal single letter abbreviations according to these motifs. In a preferred embodiment, the N-terminal amino acid of the NEOKINE CXC signature motif is the N-terminal amino acid of the mature NEOKINE protein.

Accordingly, in one embodiment, a NEOKINE protein is human NEOKINE-1 which contains a NEOKINE CXC signature motif containing about amino acids 25-72 of SEQ ID NO:116 having the sequence CXC at amino acid residues 25-27, and having 4 conserved cysteine residues at the positions indicated in FIG. 5. In another embodiment, a NEOKINE protein is murine NEOKINE-1 which contains a NEOKINE CXC signature motif containing about amino acids 25-72 of SEQ ID NO:119 having the sequence CXC at amino acid residues 25-27, and having 4 conserved cysteine residues at the positions indicated in FIG. 5. In another embodiment, a NEOKINE protein is rat NEOKINE-1 which contains a NEOKINE CXC signature motif containing at least amino acids 4-51 of SEQ ID NO:122, having 4 conserved cysteine residues at the positions indicated in FIG. 5. In another embodiment, a NEOKINE protein is macaque NEOKINE-1 which contains a NEOKINE CXC signature motifcontaining at least amino acids 20-67 of SEQ ID NO:135, having 4 conserved cysteine residues at the positions indicated in FIG. 5.

In another embodiment of the invention, a NEOKINE protein has at least one NEOKINE CXC signature motif and a signal sequence. As used herein, a "signal sequence" refers to a peptide containing about 20 amino acids which occurs at the N-terminus of secretory and integral membrane proteins and which contains a majority of hydrophobic amino acid residues. For example, a signal sequence contains at least about 14-28 amino acid residues, preferably about 16-26 amino acid residues, more preferably about 18-24 amino acid residues, and more preferably about 20-22 amino acid residues, and has at least about 40-70%, preferably about 50-65%, and more preferably about 55-60% hydrophobic amino acid residues (e.g., Alanine, Valine, Leucine, Isoleucine, Phenylalanine, Tyrosine, Tryptophan, or Proline). Such a "signal sequence", also referred to in the art as a "signal peptide", serves to direct a protein containing such a sequence to a lipid bilayer. For example, in one embodiment, a NEOKINE-1 protein contains a signal sequence of about amino acids 1-22 of SEQ ID NO:116. In another embodiment, a NEOKINE-2 protein contains a signal sequence of about amino acids 1-22 of SEQ ID NO:119. In another embodiment, a NEOKINE-2 protein contains a signal sequence of about amino acids 1-17 of SEQ ID NO:135.

Accordingly, one embodiment of the invention features a NEOKINE protein having at least a NEOKINE CXC signature motif. Another embodiment features a NEOKINE protein having at least a NEOKINE CXC signature motif and a signal peptide.

Preferred NEOKINE molecules of the present invention have an amino acid sequence sufficiently homologous to the amino acid sequence of SEQ ID NO:116, SEQ ID NO:119, SEQ ID NO:122, or SEQ ID NO:125. As used herein, the term "sufficiently homologous" refers to a first amino acid or nucleotide sequence which contains a sufficient or minimum number of identical or equivalent (e.g., an amino acid residue which has a similar side chain) amino acid residues or nucleotides to a second amino acid or nucleotide sequence such that the first and second amino acid or nucleotide sequences share common structural domains and/or a common functional activity. For example, amino acid or nucleotide sequences which share common structural domains have at least about 50% homology, preferably 60% homology, more preferably 70%-80%, and even more preferably 90-95% homology across the amino acid sequences of the domains and contain at least one and preferably two structural domains, are defined herein as sufficiently homologous. Furthermore, amino acid or nucleotide sequences which share at least 50%, preferably 60%, more preferably 70-80, or 90-95% homology and share a common functional activity are defined herein as sufficiently homologous.

As used interchangeably herein, an "NEOKINE activity", "biological activity of NEOKINE" or "functional activity of NEOKINE", refers to an activity exerted by a NEOKINE protein, polypeptide or nucleic acid molecule on a NEOKINE responsive cell as determined in vivo, or in vitro, according to standard techniques. In one embodiment, a NEOKINE activity is a direct activity, such as an association with a NEOKINE-target molecule. As used herein, a "target molecule" or "binding partner" is a molecule with which a NEOKINE protein binds or interacts in nature, such that NEOKINE-mediated function is achieved. A NEOKINE target molecule can be a non-NEOKINE molecule or a NEOKINE protein or polypeptide of the present invention. In an exemplary embodiment, a NEOKINE target molecule is a carbohydrate molecule on the cell membrane (e.g., heparan sulfate). In another exemplary embodiment, a NEOKINE target molecule is a membrane-bound protein (e.g., a "NEOKINE receptor").

In another embodiment, a NEOKINE target is a membrane-bound chemokine receptor. In another embodiment, a NEOKINE target is an protein molecule (e.g., a "NEOKINE binding partner"). In such an exemplary embodiment, a NEOKINE binding partner can be an non-NEOKINE protein or a second NEOKINE protein molecule of the present invention. Alternatively, a NEOKINE activity is an indirect activity, such as a cellular signaling activity mediated by interaction of the NEOKINE protein with a second protein (e.g., a NEOKINE receptor or a receptor specific for another chemokine).

In one embodiment, a NEOKINE activity is at least one or more of the following activities: (i) interaction of a NEOKINE protein with a membrane-bound NEOKINE receptor (e.g., RDC1); (ii) interaction of a NEOKINE protein with a membrane-bound chemokine receptor; (iii) indirect interaction of a NEOKINE protein with an intracellular protein via a membrane-bound NEOKINE receptor (e.g., RDC1); (iv) indirect interaction of a NEOKINE protein with an intracellular protein via a membrane-bound chemokine receptor; (v) complex formation between a soluble NEOKINE protein and a NEOKINE binding partner; (vi) inhibition of the interaction of chemokines (e.g., pro-inflammatory chemokines) by binding to their cognate receptors; (vii) inhibition of the binding of HIV to HIV co-receptors; and (vii) inhibition of the binding of HIV to HIV co-receptors wherein said binding induces subsequent infection of susceptible cells.

In another embodiment, a NEOKINE activity is at least one or more of the following activities: (1) modulation of cellular signal transduction, either in vitro or in vivo; (2) regulation of gene transcription in a cell expressing a NEOKINE receptor or a chemokine receptor; (3) regulation of gene transcription in a cell expressing a NEOKINE receptor (e.g., RDC1) or a chemokine receptor, wherein said cell is involved in angiogenesis or inflammation; (4) regulation of angiogenesis; (5) regulation of angiogenesis, wherein said regulation comprises inhibition of angiogenesis; (6) regulation of angiogenesis, wherein said regulation comprises maintenance of angiostasis; (7) regulation of inflammation; (8) inhibition of chemoattraction (e.g., neutrophil chemoattraction); and (9) inhibition of pro-inflammatory chemokines by binding to their cognate receptors.

In a preferred embodiment of the invention a NEOKINE or NEOKINE modulator is useful for regulating, preventing and/or treating at least one or more of the following proliferative diseases or disorders: (1) cancers of the epithelia (e.g., carcinomas of the pancreas, stomach, liver, secretory glands (e.g., adenocarcinoma) bladder, lung, breast, skin (e.g., malignant melanoma), reproductive tract including prostate gland, ovary, cervix and uterus); (2) cancers of the hematopoietic and immune system (e.g., leukemias and lymphomas); (3) cancers of the central nervous, brain system and eye (e.g., gliomas, neuroblastoma and retinoblastoma); and (4) cancers of connective tissues, bone, muscles and vasculature (e.g., sarcomas).

In yet another embodiment of the invention, a NEOKINE or NEOKINE modulator is useful for regulating, preventing and/or treating at least one or more of the following diseases or disorders: (1) inflammation; (2) psoriasis; (3) immune rejection following skin graft; (4) immune rejection following kidney transplant; (5) kidney inflammation in acute renal failure; (6) brain inflammation following stroke or ischaemia; and (7) brain inflammation following viral infection.

Accordingly, another embodiment of the invention features isolated NEOKINE proteins and polypeptides having a NEOKINE activity. Preferred NEOKINE proteins have at least one NEOKINE CXC signature motif and a NEOKINE activity. In another preferred embodiment, a NEOKINE protein further comprises a signal sequence. In still another preferred embodiment, a NEOKINE protein has a NEOKINE CXC signature motif, a NEOKINE activity, and an amino acid sequence sufficiently homologous to an amino acid sequence of SEQ ID NO:116, SEQ ID NO:119, SEQ ID NO:122, or SEQ ID NO:125.

The human NEOKINE-1 cDNA, which is approximately 1564 nucleotides in length, encodes a protein which is approximately 99 amino acid residues in length. The human NEOKINE-1 protein contains at least a NEOKINE CXC signature motif. A NEOKINE CXC signature motif can be found at least, for example, from about amino acids 25-72 of SEQ ID NO:116. The human NEOKINE-1 protein is predicted to be a secreted protein which further contains a signal sequence at about amino acids 1-22 of SEQ ID NO:116. The prediction of such a signal peptide can be made, for example, utilizing the computer algorithm SIGNALP (Henrik, et al. (1997) *Protein Engineering* 10:1-6).

The murine NEOKINE-1 cDNA, which is approximately 1564 nucleotides in length, encodes approximately 99 amino acid residues of the murine NEOKINE-1 protein. The murine NEOKINE-1 protein contains a NEOKINE CXC signature motif. A NEOKINE CXC signature motif can be found at least, for example, from about amino acids 25-72 of SEQ ID NO:119. The murine NEOKINE-1 protein is predicted to be a secreted protein which further contains a signal sequence at about amino acids 1-22 of SEQ ID NO:119.

The rat NEOKINE-1 cDNA, which is approximately 1372 nucleotides in length, encodes approximately 79 amino acid residues of the rat NEOKINE-1 protein. The rat NEOKINE-1 protein contains a NEOKINE CXC signature motif. A NEOKINE CXC signature motif comprises at least about amino acids 4-51 of SEQ ID NO:122. The rat NEOKINE-1 protein is predicted to be a secreted protein.

The macaque NEOKINE-1 cDNA, which is approximately 1458 nucleotides, encodes approximately 94 amino acid residues of the macaque NEOKINE-1 protein. The macaque NEOKINE-1 protein contains a NEOKINE CXC signature motif. A NEOKINE CXC signature motif comprises at least about amino acids 20-67 of SEQ ID NO:135. The macaque NEOKINE-1 protein is predicted to be a secreted protein which further contains a signal sequence including at least amino acids 1-17 of SEQ ID NO:135.

Tango 129

Members of the tumor necrosis factor (TNF) superfamily and their receptors, both of which are expressed on activated T cells and elsewhere, are thought to play an important role in T-cell activation and stimulation, cell proliferation and differentiation, as well as apoptosis.

Proteins that are members of the TNF superfamily initiate signal transduction by binding to receptors, members of the TNF receptor (TNFR) superfamily, which lack intrinsic catalytic activity. This is in marked contrast epidermal growth factor and platelet-derived growth factor both of which bind to receptors having an intracellular tyrosine kinase domain which causes receptor autophosphorylation and initiates downstream phosphorylation events.

Members of the TNFR superfamily carry out signal transduction by interacting with members of the Janus or JAK family of tyrosine kinases. In turn, JAK family members interact with STAT (signal transducers and activators of transcription) family members, a class of transcriptional activators.

The present invention is based on the discovery of a cDNA molecule encoding human TANGO129 (T129), a member of the TNF receptor superfamily.

A nucleotide sequence encoding a human T129 protein is shown in SEQ ID NO:137; and SEQ ID NO:139 (open reading frame only). A predicted amino acid sequence of T129 protein is also shown in SEQ ID NO:138.

The T129 cDNA of SEQ ID NO:137, which is approximately 2570 nucleotides long including untranslated regions, encodes a protein amino acid having a molecular weight of approximately 46 kDa (excluding post-translational modifications).

Alignment of the TNFR/NGFR cysteine-rich domain of human T129 protein (SEQ ID NO: 142) with a TNFR/NGFR cysteine-rich domain consensus derived from a hidden Markov model (PF00020; SEQ ID NO:5), revealed some similarity.

An approximately 3.0 kb T129 mRNA transcript is expressed at a moderate level in peripheral blood leukocytes, spleen, and skeletal muscle. Lower levels of this transcript were observed in heart, brain, and placenta. Human T129 is one member of a family of molecules (the "T129 family") having certain conserved structural and functional features. The term "family" when referring to the protein and nucleic acid molecules of the invention is intended to mean two or more proteins or nucleic acid molecules having a common structural domain and having sufficient amino acid or nucleotide sequence identity as defined herein. Such family members can be naturally occurring and can be from either the same or different species. For example, a family can contain a first protein of human origin and a homologue of that protein of murine origin, as well as a second, distinct protein of human origin and a murine homologue of that protein. Members of a family may also have common functional characteristics.

In one embodiment, a T129 protein includes a TNFR/NGFR domain having at least about 65%, preferably at least about 75%, and more preferably about 85%, 95%, or 98% amino acid sequence identity to the TNFR/NGFR domain of SEQ ID NO:141.

Preferred T129 polypeptides of the present invention have an amino acid sequence sufficiently identical to the TNFR/NGFR domain amino acid sequence of SEQ ID NO:141. As used herein, the term "sufficiently identical" refers to a first amino acid or nucleotide sequence which contains a sufficient or minimum number of identical or equivalent (e.g., an amino acid residue which has a similar side chain) amino acid residues or nucleotides to a second amino acid or nucleotide sequence such that the first and second amino acid or nucleotide sequences have a common structural domain and/or common functional activity. For example, amino acid or nucleotide sequences which contain a common structural domain having about 65% identity, preferably 75% identity, more preferably 85%, 95%, or 98% identity are defined herein as sufficiently identical.

As used interchangeably herein a "T129 activity", "biological activity of T129" or "functional activity of T129", refers to an activity exerted by a T129 protein, polypeptide or nucleic acid molecule on a T129 responsive cell as determined in vivo, or in vitro, according to standard techniques. A T129 activity can be a direct activity, such as an association with or an enzymatic activity on a second protein or an indirect activity, such as a cellular signaling activity mediated by interaction of the T129 protein with a second protein. In a preferred embodiment, a T129 activity includes at least one or more of the following activities: (i) interaction with proteins in the T129 signaling pathway (ii) interaction with a T129 ligand; or (iii) interaction with an intracellular target protein.

Accordingly, another embodiment of the invention features isolated T129 proteins and polypeptides having a T129 activity.

Yet another embodiment of the invention features T129 molecules which contain a signal sequence. Generally, a signal sequence (or signal peptide) is a peptide containing about 20 amino acids which occurs at the extreme N-terminal end of secretory and integral membrane proteins and which contains large numbers of hydrophobic amino acid residues and serves to direct a protein containing such a sequence to a lipid bilayer.

A259

The A259 proteins and nucleic acid molecules comprise a family of molecules having certain conserved structural and functional features. As used herein, the term "family" is intended to mean two or more proteins or nucleic acid molecules having a common structural domain and having sufficient amino acid or nucleotide sequence identity as defined herein. Family members can be from either the same or different species. For example, a family can comprises two or more proteins of human origin, or can comprise one or more proteins of human origin and one or more of non-human origin. Members of the same family may also have common structural domains.

For example, A259 proteins of the invention have signal sequences. As used herein, a "signal sequence" includes a peptide of at least about 15 or 20 amino acid residues in length which occurs at the N-terminus of secretory and membrane-bound proteins and which contains at least about 70% hydrophobic amino acid residues such as alanine, leucine, isoleucine, phenylalanine, proline, tyrosine, tryptophan, or valine. In a preferred embodiment, a signal sequence contains at least about 10 to 40 amino acid residues, preferably about 15-30 amino acid residues, more preferably about 22 amino acid residues, and has at least about 60-80%, more preferably 65-75%, and more preferably at least about 70% hydrophobic residues. A signal sequence serves to direct a protein containing such a sequence to a lipid bilayer. Thus, in one embodiment, an A259 protein contains a signal sequence at about amino acids 1 to 22 of SEQ ID NO:147 (SEQ ID NO:149). The signal sequence is cleaved during processing of the mature protein.

In another example, an A259 family member also includes one or more of the following domains: (1) an extracellular domain; (2) a transmembrane domain; and (3) a cytoplasmic domain. Thus, in one embodiment, an A259 protein contains an extracellular domain at about amino acids 1 to 1141 of SEQ ID NO:147 (SEQ ID NO:150). In another embodiment, an A259 protein contains a transmembrane domain at about amino acids 1142 to 1164 of SEQ ID NO:147 (SEQ ID NO:159). In another embodiment, an A259 protein contains a cytoplasmic domain at about amino acids 1165 to 1188 of SEQ ID NO:147 (SEQ ID NO:160).

In one embodiment, the extracellular domain of A259 can include an inserted domain ("I" domain). In another embodiment, the I domain is located between integrin α-subunit repeat domains 2 and 3.

In a preferred embodiment, an A259 family member has the amino acid sequence of SEQ ID NO: 147 wherein the extracellular domain is located at about amino acids 1 to 1141 (SEQ ID NO:150), the I domain (SEQ ID NO:151) is located at about amino acid positions 164 to 345, and the integrin α-subunit repeat domains on either side of the I domain (integrin α-subunit repeat domains 2 and 3) are located at amino acid positions 115 to 157 (SEQ ID NO:153) and 367 to 392 (SEQ ID NO:154), respectively.

An A259 family member can include one or more integrin α-subunit repeat domains within the extracellular domain. As used herein, a "repeat domain" refers to one or more of seven homologous protein domains that are conserved in integrin α-subunit family members, which are about 10 to 65 residues, preferably about 20 to 50 residues, more preferably about 25 to 45 amino acid residues, and most preferably about 26 to 43 residues, in length, and which are about 10 to 50, preferably about 15 to 40, more preferably about 20 to 35 amino acids apart from one another.

A repeat domain typically has one of the two following consensus sequences. The first repeat consensus sequence (type 1) is: F-G-Xaa(n)-[G or A]-A-[P or L or Q] (SEQ ID NO:189), wherein F is phenylalanine, G is glycine, Xaa is any amino acid, n is about 10 to 30 amino acid residues, preferably about 15 to 20 amino acid residues, more preferably about 16 to 19 amino acid residues, A is alanine, P is proline, L is leucine, and Q is glutamine. The second repeat consensus sequence (type 2) is: [G or S]-[F or Y]-Xaa(n)-[G or V or L]-[A or M]-[P or Y] (SEQ ID NO:190), wherein G is glycine, S is serine, F is phenylalanine, Y is tyrosine, Xaa is any amino acid, n is about 5 to 40 amino acid residues, preferably about 10 to 35 amino acid residues, more preferably about 14 to 33 amino acid residues, V is valine, A is alanine, M is methionine, and P is proline.

In one embodiment, an A259 family member includes one or more repeat domains having an amino acid sequence that is at least about 55%, preferably at least about 65%, more preferably at least about 75%, yet more preferably at least about 85%, and most preferably at least about 95% identical to amino acids 39 to 74, and/or 115 to 157, and/or 367 to 392, and/or 421 to 455, and/or 478 to 516, and/or 540 to 575, and/or 602 to 640 of SEQ ID NO:147, which are the repeat domains of A259 (these repeat domains are also represented as SEQ ID NO:152, 153, 154, 155, 156, 157, and 158, respectively). In another embodiment, an A259 family member includes one or more repeat domains having an amino acid sequence that is at least about 55%, preferably at least about 65%, more preferably at least about 75%, yet more preferably at least about 85%, and most preferably at least about 95% identical to amino acids 39 to 74, and/or 115 to 157, and/or 367 to 392, and/or 421 to 455, and/or 478 to 516, and/or 540 to 575, and/or 602 to 640 of SEQ ID NO:147, which are the repeat domains of A259 (these repeat domains are also represented as SEQ ID NO:152, 153, 154, 155, 156, 157, and 158, respectively), and has one or more repeat consensus sequences described herein. In another embodiment, an A259 family member includes one or more repeat domains having an amino acid sequence that is at least about 55%, preferably at least about 65%, more preferably at least about 75%, yet more preferably at least about 85%, and most preferably at least about 95% identical to amino acids 39 to 74, and/or 115 to 157, and/or 367 to 392, and/or 421 to 455, and/or 478 to 516, and/or 540 to 575, and/or 602 to 640 of SEQ ID NO:147, which are the repeat domains of A259 (these repeat domains are also represented as SEQ ID NO:152, 153, 154, 155, 156, 157, and 158, respectively), has one or more I consensus sequences described herein, and has at least one A259 biological activity as described herein.

An A259 family member can also include an inserted, or I domain (also called von Willebrand factor type A domain). As used herein, an "I domain" refers to a domain that appears in only some of the integrin α subunits, e.g., a1, a2, aM, and aX, and that is inserted between the second and third integrin α-subunit repeat domains. I domains prevent the occurrence of proteolytic cleavage that separates integrin α subunits into heavy and light fragments that are disulfide linked. An I domain includes about 100 to 300 amino acid residues, preferably about 150 to 200 amino acid residues, more preferably about 160 to 190 amino acid residues, and most preferably about 182 amino acid residues.

An I domain typically has the following consensus sequence: D-G-S-Xaa-S-Xaa(n1)-F-Xaa(n2)-Q-Y (SEQ ID NO:191), wherein D is aspartic acid, G is glycine, S is serine, Xaa is any amino acid, n1 is about 5 to 15, preferably about 8 to 12, more preferably about 9 to 11 amino acid residues, F is phenylalanine, n2 is about 15 to 30, preferably 18 to 28, more preferably about 20 to 26 amino acid residues, Q is glutamine, and Y is tyrosine.

In one embodiment, an A259 family member includes an I domain having an amino acid sequence that is at least about 55%, preferably at least about 65%, more preferably at least about 75%, yet more preferably at least about 85%, and most preferably at least about 95% identical to amino acids 164 to 345 of SEQ ID NO:147, which is the I domain of A259 (this I domain is also represented as SEQ ID NO:151). In another embodiment, an A259 family member includes an I domain having an amino acid sequence that is at least about 55%, preferably at least about 65%, more preferably at least about 75%, yet more preferably at least about 85%, and most preferably at least about 95% identical to amino acids 164 to 345 of SEQ ID NO:147, which is the I domain of A259 (this I domain is also represented as SEQ ID NO:151), and an I domain consensus sequence described herein. In another embodiment, an A259 family member includes an I domain having an amino acid sequence that is at least about 55%, preferably at least about 65%, more preferably at least about 75%, yet more preferably at least about 85%, and most preferably at least about 95% identical to amino acids 164 to 345 of SEQ ID NO:147, which is the I domain of A259 (this I domain is also represented as SEQ ID NO:151). In another embodiment, an A259 family member includes an I domain having an amino acid sequence that is at least about 55%, preferably at least about 65%, more preferably at least about 75%, yet more preferably at least about 85%, and most preferably at least about 95% identical to amino acids 164 to 345 of SEQ ID NO:147, which is the I domain of A259 (this I domain is also represented as SEQ ID NO:151), has one or more I domain consensus sequences described herein, and has at least one A259 biological activity as described herein.

An A259 family member can also include a cytoplasmic domain. The cytoplasmic domain typically includes about 10 to 40, preferably about 20 to 30, more preferably about 22 to 28, still more preferably about 22 to 26 amino acid residues in length. The A259 cytoplasmic domain typically has the following consensus sequence: [F or Y or W or S]-[R or K]-Xaa(n1)-G-F—F-Xaa(n2)-R (SEQ ID NO:192), wherein F is phenylalanine, Y is tyrosine, W is tryptophan, S is serine, R is arginine, K is lysine, Xaa is any amino acid, n1 and n2 are 0 to 1, and G is glycine.

In a preferred embodiment, an A259 family member has the amino acid sequence of SEQ ID NO: 147 wherein the cytoplasmic domain is located at about amino acids 1165 to 1188 (SEQ ID NO: 160) and the cytoplasmic domain consensus sequence is located from about amino acid 1165 to 1170.

Various features of human and murine A259 are summarized below.

Human A259

A cDNA encoding human A259 was identified by analyzing the sequences of clones present in an LPS stimulated human primary osteoblast cDNA library. This analysis led to the identification of a clone, Atho002i17, encoding full-length human A259. The human A259 cDNA of this clone is 5042 nucleotides long (SEQ ID NO:145). The open reading frame of this cDNA, nucleotides 127 to 3690 of SEQ ID NO:145 (SEQ ID NO:146), encodes a 1188 amino acid receptor protein (SEQ ID NO:147).

The signal peptide prediction program SIGNALP (Nielsen et al. (1997) *Protein Engineering* 10:1-6) predicted that human A259 includes a 22 amino acid signal peptide (amino acid 1 to about amino acid 22 of SEQ ID NO:147; SEQ ID NO:149) preceding the mature A259 protein (corresponding to about amino acid 23 to amino acid 1188 of SEQ ID NO:147) (SEQ ID NO:148). The human A259 protein molecular weight is 133.5 kDa prior to the cleavage of the signal peptide, 131.1 kDa after cleavage of the signal peptide.

Human A259 includes a extracellular domain (about amino acids 1 to 1141 of SEQ ID NO:147; SEQ ID NO:150), an I domain (also called a Von Willebrand Factor type A domain; about amino acids 164 to 345 of SEQ ID NO:147; SEQ ID NO:151), seven repeat domains (about amino acids 39 to 74, 115 to 157, 367 to 392, 421 to 455, 478 to 516, 540 to 575, and 602 to 640 of SEQ ID NO:147 (SEQ ID NO:152, 153, 154, 155, 156, 157, and 158, respectively)), a transmembrane domain (about amino acids 1142 to 1164 of SEQ ID NO:147; SEQ ID NO:159), and a cytoplasmic domain (about amino acids 1165 to 1188 of SEQ ID NO:147; SEQ ID NO:160).

A slightly different model of the integrin alpha repeat domain identifies five integrin alpha repeat domains within human A259 (about amino acids 37-90, 421-472, 476-532, 538-593, and 600-654 of SEQ ID NO:147 (SEQ ID NOS: 179, 180, 181, 182, and 183, respectively)). These domains were identified by homology searching using consensus domains derived from hidden Markov models (HMMs). HMMs can be used to do multiple sequence alignment and very sensitive database searching, using statistical descriptions of a sequence family's consensus. FIG. 9A depicts an alignment of amino acids 37-90 of human A259 (SEQ ID NO:179) with a consensus integrin alpha repeat domain derived from a hidden Markov model (SEQ ID NO:184). FIG. 9B depicts an alignment of amino acids 421-472 of human A259 (SEQ ID NO:180) with a consensus integrin alpha repeat domain derived from a hidden Markov model (SEQ ID NO:184). FIG. 9C depicts an alignment of amino acids 476-532 of human A259 (SEQ ID NO:181) with a consensus integrin alpha repeat domain derived from a hidden Markov model (SEQ ID NO:184). FIG. 9D depicts an alignment of amino acids 538-593 of human A259 (SEQ ID NO:182) with a consensus integrin alpha repeat domain derived from a hidden Markov model (SEQ ID NO:184). FIG. 9E depicts an alignment of amino acids 600-654 of human A259 (SEQ ID NO:183) with a consensus integrin alpha repeat domain derived from a hidden Markov model (SEQ ID NO:184).

Predicted N-glycosylation sites are found from amino acids 82 to 85, 95 to 98, 291 to 294, 331 to 334, 358 to 361, 449 to 452, 462 to 465, 528 to 531, 642 to 645, 694 to 697, 857 to 860, 894 to 897, 973 to 976, 1031 to 1034, 1039 to 1042 and 1059 to 1062 of SEQ ID NO:147. A cAMP and cGMP-dependent protein kinase phosphorylation site is found from amino acids 700 to 703 of SEQ ID NO:147.

Predicted protein kinase C phosphorylation sites are found from amino acids 27 to 29, 97 to 99, 221 to 223, 287 to 289, 355 to 357, 434 to 436, 451 to 453, 530 to 532, 548 to 550, 587 to 589, 662 to 664, 703 to 705, 716 to 718, 770 to 772, 833 to 835, 938 to 940, 1092 to 1094, 1100 to 1102, 1171 to 1173 and 1183 to 1185 of SEQ ID NO:147.

Predicted casein kinase II phosphorylation sites are found from amino acids 161 to 164, 221 to 224, 230 to 233, 270 to 273, 287 to 290, 322 to 325, 485 to 488, 530 to 533, 548 to 551, 556 to 559, 593 to 596, 662 to 665, 696 to 669, 724 to 727, 753 to 756, 801 to 804, 938 to 941, 966 to 969, 974 to 977, 1046 to 1049, 1061 to 1064 and 1133 to 1136 of SEQ ID NO:147.

A predicted tyrosine kinase phosphorylation site is found from amino acids 812 to 820 of SEQ ID NO:147.

Predicted N-myristoylation sites are found from amino acids 6 to 11, 35 to 40, 106 to 111, 236 to 241, 245 to 250, 257 to 262, 354 to 359, 363 to 368, 379 to 384, 422 to 427, 473 to 478, 481 to 486, 543 to 548, 625 to 630, 690 to 695, 725 to 730, 877 to 882, 930 to 935 and 1147 to 1152 of SEQ ID NO:147.

A predicted amidation site is found from amino acids 257 to 260 of SEQ ID NO:147. An immunoglobulin and major histocompatibility complex proteins signature is found from amino acids 74 to 80 of SEQ ID NO:147.

Human A259 is homologous to human integrin α10 (SEQ ID NO:161; GenBank Accession Number AF074015), a β1-associated collagen binding integrin (Camper, Hellman, and Lundgren-Akerlund (1998) *Journal of Biol. Chem.* 273, 32:20383-20389). The human A259 signal sequence is represented by amino acids 1 to 22 (and encoded by nucleotides 127 to 192 of SEQ ID NO:145). The human α10 integrin signal sequence is represented by amino acids 1 to 22 (and encoded by nucleotides 22 to 87 of SEQ ID NO:161). The human A259 extracellular domain sequence (SEQ ID NO:150) is represented by amino acids 1 to 1141 (and encoded by nucleotides 127 to 3549 of SEQ ID NO:145), and the human α10 extracellular domain sequence is represented by amino acids 1 to 1098 (and encoded by nucleotides 22 to 3381 of SEQ ID NO:161). The human A259 I domain (SEQ ID NO:151) is represented by amino acids 164 to 345 (and encoded by nucleotides 616 to 1161 of SEQ ID NO:145), and the human α10 I domain is represented by amino acids 140 to 337 (and encoded by nucleotides 505 to 1098 of SEQ ID NO:161). The human A259 transmembrane domain (SEQ ID NO:159) is represented by amino acids 1142 to 1164 (and encoded by nucleotides 3550 to 3618 of SEQ ID NO:145), and the human α10 transmembrane domain is represented by amino acids 1099 to 1123 (and encoded by nucleotides 3382 to 3456 of SEQ ID NO:161). The human A259 cytoplasmic domain (SEQ ID NO:160) is represented by amino acids 1165 to 1188 (and encoded by nucleotides 3619 to 3690 of SEQ ID NO:145), and the human α10 cytoplasmic domain is represented by amino acids 1124 to 1145 (and encoded by nucleotides 3457 to 3522 of SEQ ID NO:161).

Alignments have shown that there is an overall 46.3% identity between the full length human A259 nucleic acid molecule and the full length human α10 molecule, and a 43.0% identity between the A259 amino acid sequence and the human α10 amino acid sequence. There is also a 55.1% identity between the human A259 and the human α10 open reading frames. There is also an overall 37.6% amino acid identity, and a 41.5% full length nucleic acid identity, between the full length human A259 nucleic acid molecule and the full length human α1 (VLA-1 (very late antigen-1) molecule.

Human A259 is homologous to murine A259. The human A259 signal sequence is represented by amino acids 1 to 22 (and encoded by nucleotides 127 to 192 of SEQ ID NO:145). The murine A259 signal sequence is represented by amino acids 1 to 22 (and encoded by nucleotides 28 to 93 of SEQ ID NO:163). The human A259 extracellular domain sequence (SEQ ID NO:150) is represented by amino acids 1 to 1141 (and encoded by nucleotides 127 to 3549 of SEQ ID NO:145), and the murine A259 extracellular domain sequence is represented by amino acids 1 to 1141 (and encoded by nucleotides 28 to 3450 of SEQ ID NO:163). The human A259 I domain (SEQ ID NO: 151) is represented by amino acids 164 to 345 (and encoded by nucleotides 616 to 1161 of SEQ ID NO:145), and the murine A259 I domain is represented by amino acids 164 to 345 (and encoded by nucleotides 517 to 1062 of SEQ ID NO:163). The human A259 repeat domains are represented by amino acids 39 to 74, 115 to 157, 367 to 392, 421 to 455, 478 to 516, 540 to 575, and 602 to 640 (and encoded by nucleotides 244 to 348, 469 to 597, 1225 to 1302, 1387 to 1491, 1558 to 1674, 1744 to 1851, and 1930 to 2046, respectively, of SEQ ID NO:145), and the murine A259 repeat domains are represented by amino acids 39 to 74, 115 to 157, 367 to 392, 421 to 455, 478 to 516, 540 to 575, and 602 to 640 (and encoded by nucleotides 145 to 249, 370 to 498, 1126 to 1203, 1288 to 1392, 1459 to 1575, 1645 to 1752, and 1831 to 1947, respectively, of SEQ ID NO:163). The human A259 transmembrane domain (SEQ ID NO:159) is represented by amino acids 1142 to 1164 (and encoded by nucleotides 3550 to 3618 of SEQ ID NO:145), and the murine A259 transmembrane domain is represented by amino acids 1142 to 1164 (and encoded by nucleotides 3283 to 3357 of SEQ ID NO:163). The human A259 cytoplasmic domain (SEQ ID NO:160) is represented by amino acids 1165 to 1188 (and encoded by nucleotides 3619 to 3690 of SEQ ID NO:145), and the murine A259 cytoplasmic domain is represented by amino acids 1165 to 1188 (and encoded by nucleotides 3358 to 3423 of SEQ ID NO:163).

Alignments show that there is an overall 78.4% identity between the full length human A259 nucleic acid molecule and the full length murine A259 molecule, and a 90.3% identity between the A259 amino acid sequence and the murine A259 amino acid sequence. There is also an 86.8% identity between the human and murine A259 open reading frames.

Clone Human I2, which encodes human A259, was deposited with the American Type Culture Collection (10801 University Boulevard, Manassas, Va. 20110-2209) on Apr. 2, 1999 and assigned Accession Number 207190. This deposit will be maintained under the terms of the Budapest Treaty on the International Recognition of the Deposit of Microorganisms for the Purposes of Patent Procedure. This deposit was made merely as a convenience for those of skill in the art and is not an admission that a deposit is required under 35 U.S.C. 112.

Figure 7:
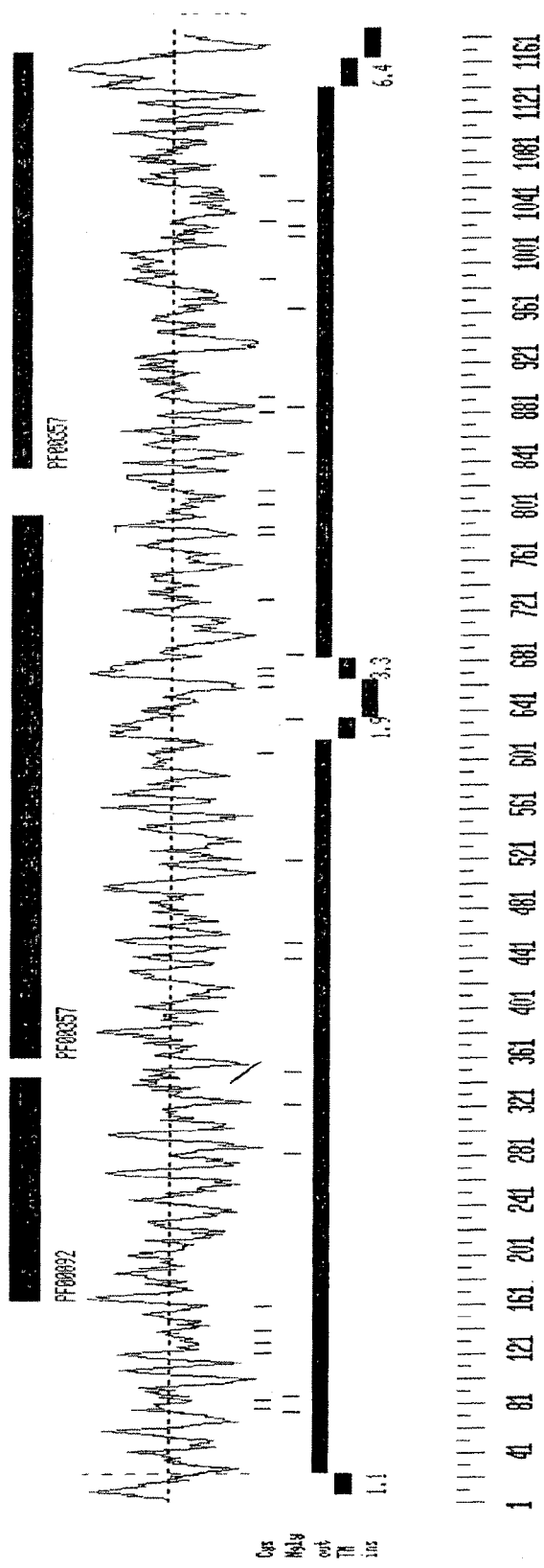
FIG. 7 depicts a hydropathy plot of human A259. Relatively hydrophobic regions of the protein are above the dashed horizontal line, and relatively hydrophilic regions of the protein are below the dashed horizontal line. The cysteine residues (cys) and potential N-glycosylation sites (Ngly) are indicated by short vertical lines just below the hydropathy trace. The dashed vertical line separates the signal sequence (amino acids 1 to 22 of SEQ ID NO:3; SEQ ID NO:5) on the left from the mature protein (amino acids 23 to 1188 of SEQ ID NO:3; SEQ ID NO:4) on the right. Thicker gray horizontal bars below the dashed horizontal line indicate extracellular ("out"), transmembrane ("TM"), and intracellular ("in") regions of the molecule.

FIG. 7 depicts a hydropathy plot of human A259. Relatively hydrophobic regions of the protein are shown above the horizontal line, and relatively hydrophilic regions of the protein are below the horizontal line. The cysteine residues (cys) and predicted N-glycosylation sites are indicated by short vertical lines just below the hydropathy trace. The dashed vertical line separates the signal sequence (amino acids 1 to 22 of SEQ ID NO:147; SEQ ID NO:149) on the left from the mature protein (amino acids 23 to 1188 of SEQ ID NO:147; SEQ ID NO:148) on the right. The A259 transmembrane domain is indicated by the section of the plot under which the number 6.4 can be seen, which represents a score assigned to the predicted transmembrane domain. The extracellular domain (SEQ ID NO:150) and cytoplasmic domain (SEQ ID NO:160) are similarly indicated by gray horizontal bars, labeled as "out" and "in", respectively.

An electronic survey of proprietary databases revealed that A259 is found in abundantly in human and mouse osteoblast cDNA libraries and also in human bone marrow and neuronal cDNA libraries. In addition, in a Northern blot containing RNA from human tissues, A259 was expressed as two messages, a 6 kb and a 4 kb message, in RNA from human osteoblasts. The sequence used to probe this human Northern blot contained human A259 C-terminal and 3' untranslated regions. The expression level in human osteoblasts did not change when stimulated with TNF-α.

Figure 10A:
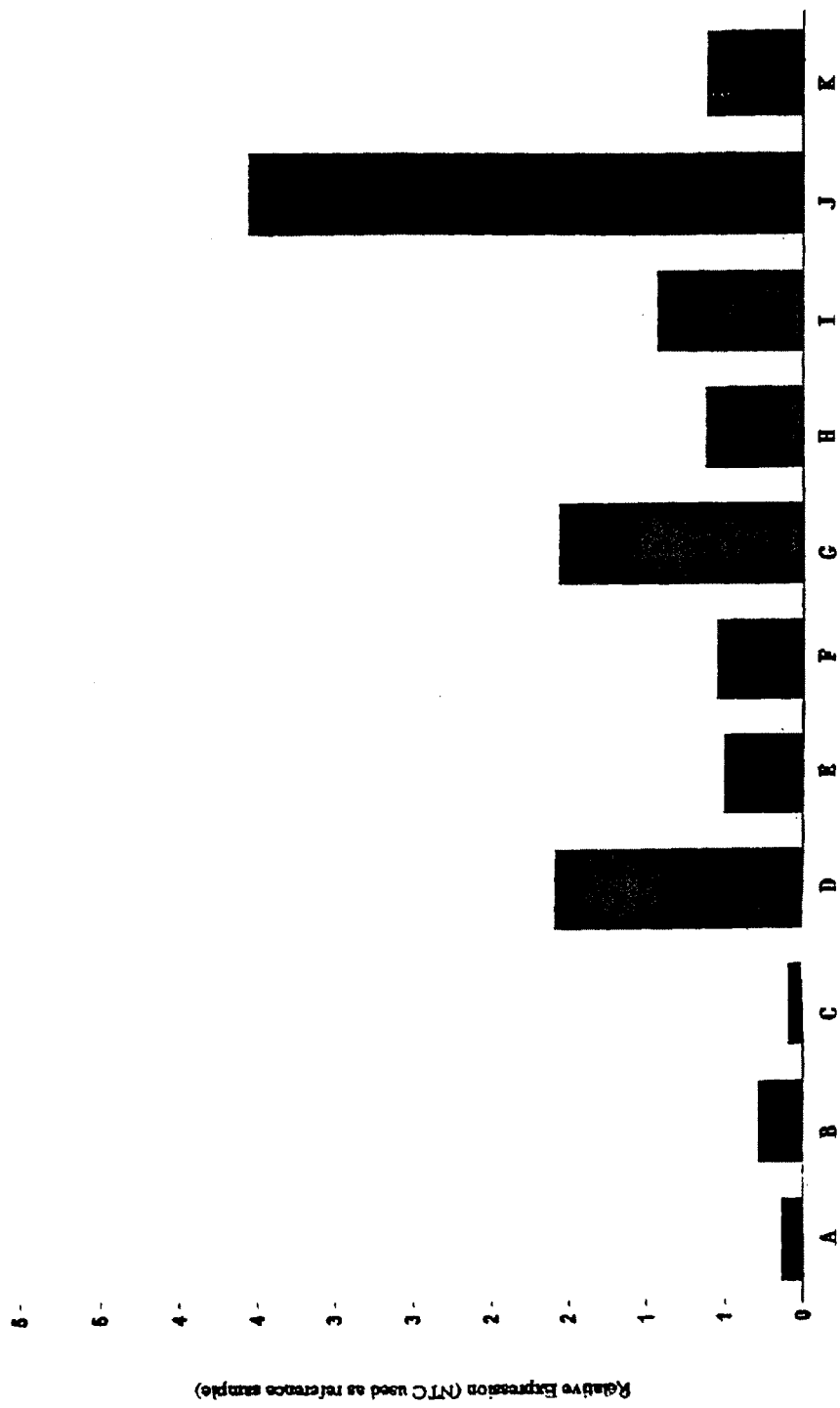
FIG. 10A is a graph depicting the results of an analysis of A259 expression in three normal liver clinical samples (A, B, and C) and eight liver fibrosis clinical samples (D, E, F, G, H, I, J, and K).
Figure 10B:
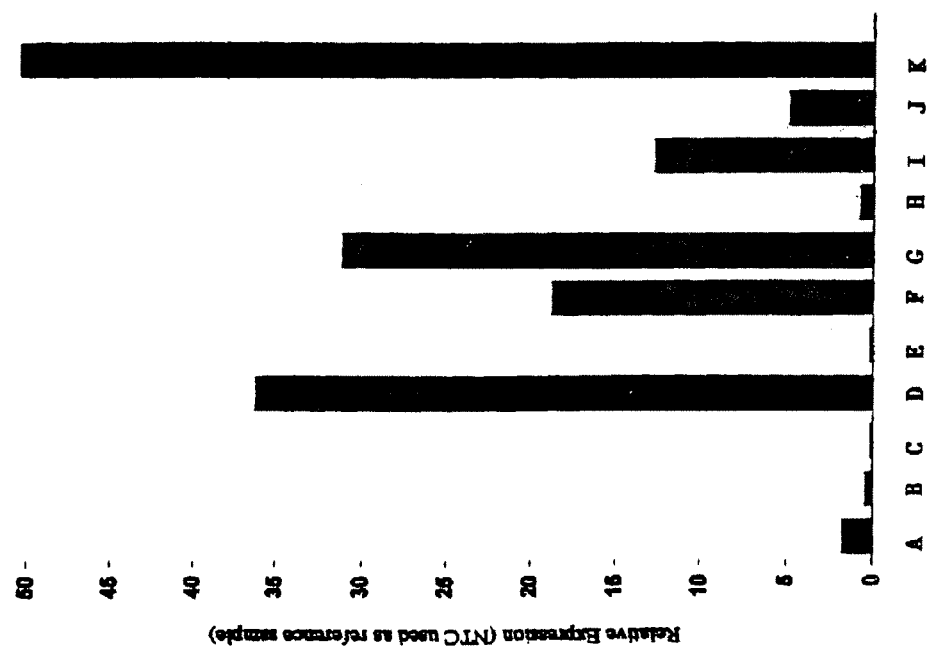
FIG. 10B is a graph depicting the results an analysis of human A259 expression in a variety of cells: heart (A), lung (B), liver (C), passaged stellate cells (D), quiescent stellate cells (E), srellate cells (F) stellate/F BS cells (G), NHDF fibroblasts (H); TGF-treated NHDF fibroblasts (I); NHLF fibroblasts (J); and TGF-treated NHLF fibroblasts (K).

The expression of human A259 was measured in various clinical liver samples taken from subjects not suffering from liver fibrosis and from patients suffering from liver fibrosis using TaqMan quantitative PCR. The results of this analysis are depicted in FIG. 10B. Human A259 was expressed at a lower level in the livers of patients not suffering from liver fibrosis (A, B, and C; relative expression 0.13, 0.29, and 0.09, respectively) than in the livers of patients suffering from liver fibrosis (D, E, F, G, H, I, J, and K; relative expression 1.59, 0.50, 0.55, 1.56, 0.62, 0.93, 3.54, and 0.61, respectively).

The expression of human A259 was measured in various cells using TaqMan quantitative PCR. The results of this analysis are depicted in FIG. 10B. The cells tested were: heart (A; relative expression 1.69), lung (B; relative expression 0.41), liver (C; relative expression 0.10), passaged stellate cells (D; relative expression 36.15), quiescent stellate cells (E; relative expression 0.15), stellate cells (F; relative expression 18.71); stellate/F BS cells (G; relative expression 31.03), NHDF fibroblasts (H; relative expression 0.71); TGF-treated NHDF fibroblasts (I; relative expression 12.69); NHLF fibroblasts (J; relative expression 4.81); and TGF-treated NHLF fibroblasts (K; relative expression 66.06).

Human A259 maps to human chromosome location hu 15q22. The flanking markers are AFMO94YC1 and NIB1778. The nearby known disease loci include: CLN6 (neuronal ceroid-lipofuscinosis) and BBS4 (Bardet-Biedl Syndrome 4). The nearby known genes include: HDC (histidine decarboxylase), LIPC (hepatic lipase), PKM2 (pyruvate kinase 3), CLN6 (neuronal ceroid-lipofuscinosis), BBS4 (Bardet-Biedl Syndrome 4), and NMB (neuromedin B). The murine syntenic chromosomal location is mo9. The known nearby loci include: rc (rough coat), ash (ashen), flail (flailer), pml (promyelotic leukemia), and sty (small thymus). The known nearby genes include: hpl (hepatitis lipase).

Murine A259

A cDNA encoding human A259 was identified by analyzing the sequences of clones present in a murine bone marrow cDNA library. This analysis led to the identification of a clone, AtmMa113d1, encoding full-length murine A259. The murine A259 cDNA of this clone is 4858 nucleotides long (SEQ ID NO:163). The open reading frame of this cDNA, nucleotides 28 to 3591 of SEQ ID NO:163 (SEQ ID NO:164), encodes a 1188 amino acid receptor protein (SEQ ID NO:165).

The signal peptide prediction program SIGNALP (Nielsen et al. (1997) Protein Engineering 10:1-6) predicted that murine A259 includes a 22 amino acid signal peptide (amino acid 1 to about amino acid 22 of SEQ ID NO:165) (SEQ ID NO:167) preceding the mature A259 protein (corresponding to about amino acid 23 to amino acid 1188 of SEQ ID NO:165) (SEQ ID NO:166). The mouse A259 protein molecular weight is 133.1 kDa prior to the cleavage of the signal peptide, 130.5 kDa after cleavage of the signal peptide.

Murine A259 includes a extracellular domain (about amino acids 1 to 1141 of SEQ ID NO:165; SEQ ID NO:168), an I domain (about amino acids 164 to 345 of SEQ ID NO:165; SEQ 169), seven repeat domains (about amino acids 39 to 74, 115 to 157, 367 to 392, 421 to 455, 478 to 516, 540 to 575, and 602 to 640 of SEQ ID NO:165 (SEQ ID NO:170, 171, 172, 173, 174, 175, and 176, respectively)), a transmembrane domain (about amino acids 1142 to 1164 of SEQ ID NO:165; SEQ ID NO:177), and a cytoplasmic domain (about amino acids 1165 to 1188 of SEQ ID NO:165; SEQ ID NO:178).

Predicted N-glycosylation sites are found from amino acids 82 to 85, 95 to 98, 291 to 294, 331 to 334, 358 to 361, 449 to 452, 462 to 465, 528 to 531, 642 to 645, 694 to 697, 857 to 860, 894 to 897, 973 to 976, 1031 to 1034, 1039 to 1042 and 1059 to 1062 of SEQ ID NO:165.

Predicted protein kinase C phosphorylation sites are found from amino acids 51 to 53, 97 to 99, 221 to 223, 287 to 289, 355 to 357, 434 to 436, 451 to 453, 530 to 532, 569 to 571, 716 to 718, 770 to 772, 833 to 835, 1092 to 1094, 1100 to 1102 and 1171 to 1173 of SEQ ID NO:165.

Predicted casein kinase II phosphorylation sites are found from amino acids 161 to 164, 221 to 224, 230 to 233, 270 to 273, 287 to 290, 322 to 325, 485 to 488, 530 to 533, 548 to 551, 556 to 559, 593 to 596, 696 to 669, 724 to 727, 753 to 756, 801 to 804, 859 to 862, 938 to 941, 966 to 969, 974 to 977, 1046 to 1049, 1061 to 1064 and 1133 to 1136 of SEQ ID NO:165.

A predicted tyrosine kinase phosphorylation site is found from amino acids 812 to 820.

Predicted N-myristoylation sites are found from amino acids 6 to 11, 106 to 111, 236 to 241, 245 to 250, 257 to 262, 354 to 359, 363 to 368, 379 to 384, 477 to 482, 543 to 548, 625 to 630, 690 to 695, 725 to 730, 1030 to 1035 and 1147 to 1152 of SEQ ID NO:165.

Predicted amidation site are found from amino acids 51 to 54 and 257 to 260 of SEQ ID NO: 165.

Clone Mouse I2, which encodes murine A259, was deposited with the American Type Culture Collection (10801 University Boulevard, Manassas, Va. 20110-2209) on Apr. 2, 1999 and assigned Accession Number 207191. This deposit will be maintained under the terms of the Budapest Treaty on the International Recognition of the Deposit of Microorganisms for the Purposes of Patent Procedure. This deposit was made merely as a convenience for those of skill in the art and is not an admission that a deposit is required under 35 U.S.C. 112.

Figure 8:
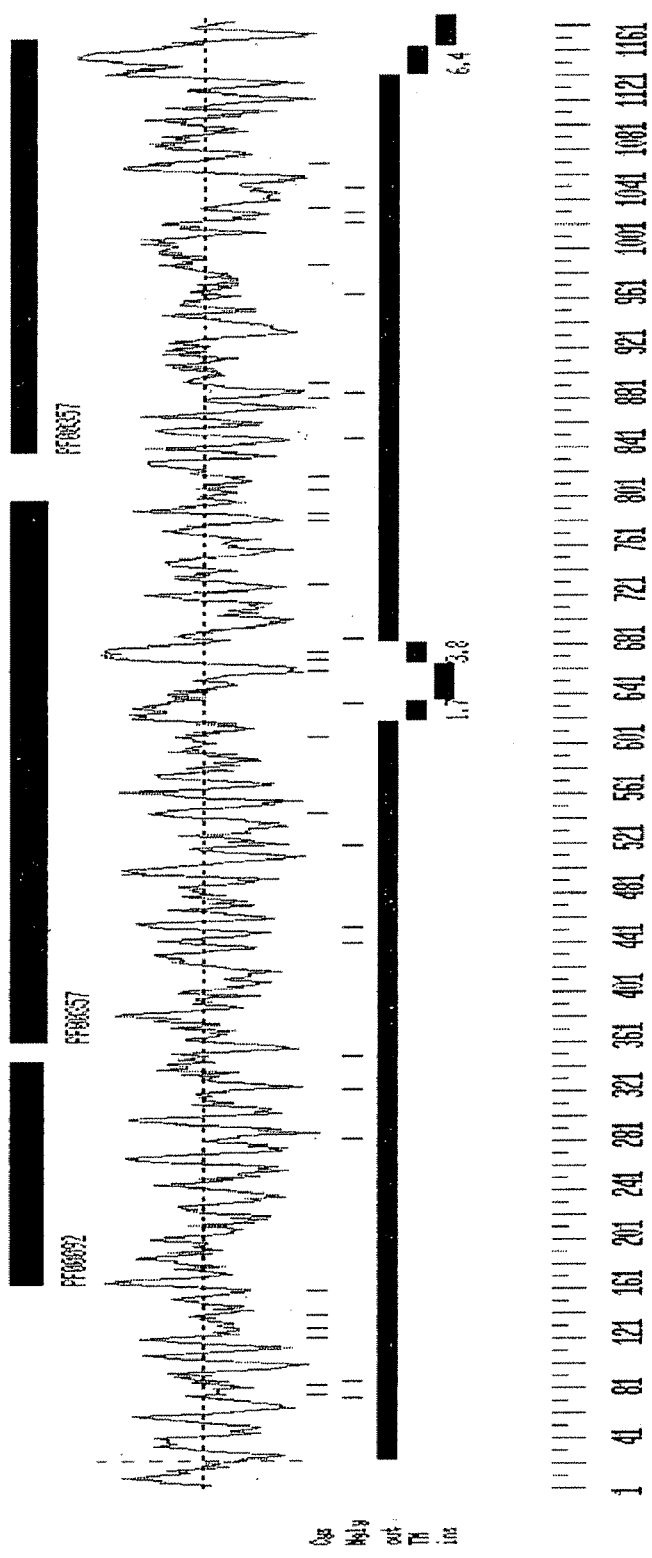
FIG. 8 depicts a hydropathy plot of murine A259. Relatively hydrophobic regions of the protein are above the dashed horizontal line, and relatively hydrophilic regions of the protein are below the dashed horizontal line. The cysteine residues (cys) and potential N-glycosylation sites (Ngly) are indicated by short vertical lines just below the hydropathy trace. The dashed vertical line separates the signal sequence (amino acids 1 to 22 of SEQ ID NO:21; SEQ ID NO:23) on the left from the mature protein (amino acids 23 to 1188 of SEQ ID NO:21; SEQ ID NO:22) on the right. Thicker gray horizontal bars below the dashed horizontal line indicate extracellular ("out"), transmembrane ("TM"), and intracellular ("in") regions of the molecule.

FIG. 8 depicts a hydropathy plot of murine A259. Relatively hydrophobic regions of the protein are shown above the horizontal line, and relatively hydrophilic regions of the protein are below the horizontal line. The cysteine residues (cys) and predicted N-glycosylation sites are indicated by short vertical lines just below the hydropathy trace. The dashed vertical line separates the signal sequence (amino acids 1 to 22 of SEQ ID NO:165; SEQ ID NO:167) on the left from the mature protein (amino acids 23 to 1188 of SEQ ID NO:165; SEQ ID NO:166) on the right. The A259 transmembrane domain is indicated by the section of the plot under which the number 6.4 can be seen, which represents a score assigned to the predicted transmembrane domain. The extracellular domain (SEQ ID NO:168) and cytoplasmic domain (SEQ ID NO:178) are similarly indicated by gray horizontal bars, labeled as "out" and "in", respectively.

In situ data of A259 expression in mouse is summarized as follows: During embryogenesis, E13.5 through postnatal day 1.5 tested, all developing bone structures have strong expression. The signal is located mostly at the edge of the developing bones. Beginning at E14.5 the bone marrow space can be seen and is negative for expression. However, some large bones have signal in the bone, not just at the edge. Signal is also observed in the small intestine, diaphragm and to a lesser extent the muscle layer under the skin. The diaphragm and intestine expression pattern is suggestive of smooth muscle. The expression in these tissues is strongest at E15.5 and E16.5 and decreases to almost background levels by P1.5. Adult expression is observed in a small number of tissues examined, including brain, submandibular gland, bladder, colon, small intestine, liver, spleen, and placenta. The signal in positive tissues is very weak in all but the mucosal epithelium of the bladder which has the strongest expression. There is no expression observed in the following tested tissues: spinal cord, eye and harderian gland, white fat, brown fat, stomach, heart, kidney, adrenal gland, thymus, lymph node, lung, pancreas, skeletal muscle, and testes.

Uses of A259 Nucleic acids, Polypeptides, and Modulators Thereof

As human A259 was originally found in a LPS stimulated human primary osteoblast library, A259 nucleic acids, proteins, and modulators thereof can be used to modulate the proliferation, differentiation, and/or function of cells that form bone matrix, e.g., osteoblasts and osteoclasts, and can be used to modulate the formation of bone matrix. Thus A259 nucleic acids, proteins, and modulators thereof can be used to treat cartilage and bone associated diseases and disorders, and can play a role in bone growth, formation, and remodeling. Examples of cartilage and bone associated diseases and disorders include e.g., bone cancer, achondroplasia, myeloma, fibrous dysplasia, scoliosis, osteoarthritis, osteosarcoma, and osteoporosis.

As murine A259 was originally found in a bone marrow library, A259 nucleic acids, proteins, and modulators thereof can be used to modulate the proliferation, differentiation, and/or function of cells that appear in the bone marrow, e.g., stem cells (e.g., hematopoietic stem cells), and blood cells, e.g., erythrocytes, platelets, and leukocytes. Thus A259 nucleic acids, proteins, and modulators thereof can be used to treat bone marrow, blood, and hematopoietic associated diseases and disorders, e.g., acute myeloid leukemia, hemophilia, leukemia, anemia (e.g., sickle cell anemia), and thalassemia.

As integrin family members play a role in immune response, A259 nucleic acids, proteins, and modulators thereof can be used to treat immune related disorders, e.g., immunodeficiency disorders (e.g., HIV), viral disorders (e.g., infection by HSV), cell growth disorders, e.g., cancers (e.g., carcinoma, lymphoma, e.g., follicular lymphoma), autoimmune disorders (e.g., arthritis, graft rejection (e.g., allograft rejection), T cell autoimmune disorders (e.g., AIDS)), and inflammatory disorders (e.g., bacterial or viral infection, psoriasis, septicemia, cerebral malaria, inflammatory bowel disease, arthritis (e.g., rheumatoid arthritis, osteoarthritis), allergic inflammatory disorders (e.g., asthma, psoriasis)).

As integrin family members play a role in cell growth, survival, proliferation, and migration, A259 nucleic acids, proteins, and modulators thereof can be used to treat apoptotic disorders (e.g., rheumatoid arthritis, systemic lupus erythematosus, insulin-dependent diabetes mellitus) proliferative disorders (e.g., cancers, e.g., B cell cancers stimulated by TNF), and disorders abnormal vascularization (e.g., cancer). In addition, A259 nucleic acids, proteins, and modulators thereof can also be used to promote vascularization (angiogenesis).

As integrins are cell adhesion molecules, A259 nucleic acids, proteins, and modulators thereof can be used to modulate disorders associated with adhesion and migration of cells, e.g., platelet aggregation disorders (e.g., Glanzmann's thromboasthemia, which is a bleeding disorders characterized by failure of platelet aggregation in response to cell stimuli), inflammatory disorders (e.g., leukocyte adhesion deficiency, which is a disorder associated with impaired migration of neutrophils to sites of extravascular inflammation), disorders associated with abnormal tissue migration during embryo development, and tumor metastasis.

A259 polypeptides, nucleic acids, and modulators thereof, can also be used to modulate the function, morphology, proliferation and/or differentiation of cells in the tissues in which it is expressed. Such molecules can be used to treat disorders associated with abnormal or aberrant metabolism or function of cells in the tissues in which it is expressed. Tissues in which A259 is expressed, and disorders of which A259 polypeptides, nucleic acids, and modulators thereof can be used to treat, include: bone (see disorders described herein); intestine (e.g., ischemic bowel disease, infective enterocolitis, Crohn's disease); brain (e.g., cerebral edema, hydrocephalus, brain herniations, iatrogenic disease (due to, e.g., infection, toxins, or drugs)); bladder (e.g., cystitis (bladder infection), incontinence); liver (e.g., jaundice, hepatic failure, hepatic circulatory disorders (e.g., hepatic vein thrombosis and portal vein obstruction and thrombosis), hepatitis (e.g., chronic active hepatitis, acute viral hepatitis, and toxic and drug-induced hepatitis), cirrhosis (e.g., alcoholic cirrhosis, biliary cirrhosis, and hemochromatosis)); spleen (e.g., amyloidosis, Niemann-Pick disease, splenomegaly); placenta (e.g., toxemia of pregnancy (e.g., preeclampsia and eclampsia, placentitis, spontaneous abortion); and neuronal tissue (e.g., epilepsy, muscular dystrophy, and neurodegenerative diseases such as Alzheimer's disease, Parkinson's disease, and Huntington's disease).

A259 is expressed at a higher level in the liver of patients suffering from liver fibrosis than in patients not suffering from liver fibrosis. Liver fibrosis, is caused by chronic injury to the liver arising from, e.g., alcohol abuse, drugs, viral infections (e.g., hepatitis B or hepatitis C), metabolic disorders (excessive iron or copper), autoimmune attack on hepatocytes or the bile duct, and congenital disorders. Liver fibrosis is a reversible condition and injury can be present for months or years before significant scar tissue accumulates. However, liver fibrosis leads to cirrhosis, which is generally not reversible.

The liver has four major components: epithelial cells (hepatocytes), endothelial cells; tissue macrophages (Kupffer cells), and a stellate cells (a type of perivascular mesenchymal cell). In normal liver the space between the epithelium and sinusoidal endothelium is filled with a type of extracellular matrix (ECM) that is somewhat similar to a basement membrane. In fibrosis the ECM undergoes a number of changes. The total content of collagens and other components increases several fold. In addition, there is an increase in fibril-forming collagens. Stellate cells are the primary fibrogenic cell of the liver. In response to injury, quiescent stellate cells are activated and become proliferative, fibrogenic, contractile myofibroblasts. Among the key mediators of these changes are: TGF-$\beta$1, MCP-1, PDGF, ET-1, and MMP-2. Kupffer cells, endothelial cells and hepatocytes produce factors which stimulate stellate cell activation. As noted above, human A259 is expressed at a high level in activated stellate cells. This result and the increased expression of A259 in clinical liver fibrosis samples, suggest that A259 plays a role in liver fibrosis. Thus, A259 nucleic acids, polypeptides, and modulators thereof can be used to diagnose and treat liver fibrosis as well as other types of fibrosis, e.g., kidney fibrosis or lung fibrosis. Thus, liver fibrosis can be treated using antibodies directed against A259, particularly the extracellular domain of A259, the I domain of A259, or a repeat domain of A259. Also useful are polypeptides which include one or more repeat domains of A259 and/or the I domain of A259.

Tables IV, V and VI below provide summaries of human A259 and murine A259 sequence information.

TABLE IV

Summary of Sequence Information of Human A259 and Murine A259.

| Gene | cDNA | Open Reading Frame | Polypeptide | ATCC Accession No. |
|---|---|---|---|---|
| Human A259 | SEQ ID NO: 145 | SEQ ID NO: 146 | SEQ ID NO: 147 | 207190 |
| Murine A259 | SEQ ID NO: 163 | SEQ ID NO: 164 | SEQ ID NO: 165 | 207191 |

TABLE V

Summary of Domains of Human A259 and Murine A259.

| Protein | Signal Sequence | Mature Protein | Extracellular Domain | Transmembrane Domain | Cytoplasmic Domain |
|---|---|---|---|---|---|
| Human A259 | aa 1-22 SEQ ID NO: 149 | aa 23-1188 SEQ ID NO: 148 | aa 1-1141 SEQ ID NO: 150 | aa 1142-1164 SEQ ID NO: 159 | aa 1165-1188 SEQ ID NO: 160 |
| Murine A259 | aa 1-22 SEQ ID NO: 167 | aa 23-1188 SEQ ID NO: 166 | aa 1-1141 SEQ ID NO: 168 | aa 1142-1164 SEQ ID NO: 177 | aa 1165-1188 SEQ ID NO: 178 |

TABLE VI

Summary of Domains of Human A259 and Murine A259.

| Protein | I Domain | Repeat Domain |
|---|---|---|
| Human A259 | aa 164-345 SEQ ID NO: 151 | aa 39-74; 115-157; 367-392; 421-455; 478-516; 540-575; 602-640, SEQ ID NO: 152-158 |
| Murine A259 | aa 164-345 SEQ ID NO: 169 | aa 39-74; 115-157; 367-392; 421-455; 478-516; 540-575; 602-640, SEQ ID NO: 170-176 |

Isolated Nucleic Acid Molecules of the Present Invention

One aspect of the invention pertains to isolated nucleic acid molecules that encode a polypeptide of the invention or a biologically active portion thereof, as well as nucleic acid molecules sufficient for use as hybridization probes to identify nucleic acid molecules encoding a polypeptide of the invention and fragments of such nucleic acid molecules suitable for use as PCR primers for the amplification or mutation of nucleic acid molecules.

As described below, one aspect of the invention pertains to isolated nucleic acids comprising nucleotide sequences encoding Delta3 polypeptides, and/or equivalents of such polypeptides or nucleic acids. The "term equivalent" is understood to include nucleotide sequences encoding functionally equivalent Delta3 polypeptides or functionally equivalent peptides having an activity of a Delta3 protein such as described herein. Equivalent nucleotide sequences also include sequences that differ by one or more nucleotide substitutions, additions or deletions, such as allelic variants, and will, therefore, include, for example, sequences that differ from the nucleotide sequence of the Delta3 nucleic acid sequence shown in any of SEQ ID NOs: 1, 3, 24, 26, 27, 29, 31, 33, 35, 37, 39, 41, 43 or 45 due to the degeneracy of the genetic code.

Another aspect of the invention pertains to isolated nucleic acid molecules that encode FTHMA-070 or T85 proteins or biologically active portions thereof, as well as nucleic acid molecules sufficient for use as hybridization probes to identify FTHMA-070 or T85-encoding nucleic acids (e.g., FTHMA-070 or T85 mRNA) and fragments for use as PCR primers for the amplification or mutation of FTHMA-070 or T85 nucleic acid molecules.

Another aspect of the invention pertains to isolated nucleic acid molecules that encode Tango-77 proteins or biologically active portions thereof, as well as nucleic acid molecules sufficient for use as hybridization probes to identify Tango-77-encoding nucleic acids (e.g., Tango-77 mRNA) and fragments for use as PCR primers for the amplification or mutation of Tango-77 nucleic acid molecules.

Yet another aspect of the invention pertains to isolated nucleic acid molecules that encode SPOIL proteins or biologically active portions thereof, as well as nucleic acid fragments sufficient for use as hybridization probes to identify SPOIL-encoding nucleic acids (e.g., SPOIL mRNA) and fragments for use as PCR primers for the amplification or mutation of SPOIL nucleic acid molecules.

Another aspect of the invention pertains to isolated nucleic acid molecules that encode NEOKINE proteins or biologically active portions thereof, as well as nucleic acid fragments sufficient for use as hybridization probes to identify NEOKINE-encoding nucleic acids (e.g., NEOKINE mRNA) and fragments for use as PCR primers for the amplification or mutation of NEOKINE nucleic acid molecules.

Another aspect of the invention pertains to isolated nucleic acid molecules that encode T129 proteins or biologically active portions thereof, as well as nucleic acid molecules sufficient for use as hybridization probes to identify T129-encoding nucleic acids (e.g., T129 mRNA) and fragments for use as PCR primers for the amplification or mutation of T129 nucleic acid molecules.

As used herein, the term "nucleic acid molecule" is intended to include DNA molecules (e.g., cDNA or genomic DNA) and RNA molecules (e.g., mRNA) and analogs of the DNA or RNA generated using nucleotide analogs. The nucleic acid molecule can be single-stranded or double-stranded, but preferably is double-stranded DNA.

An "isolated" nucleic acid molecule is one which is separated from other nucleic acid molecules which are present in the natural source of the nucleic acid. Preferably, an "isolated" nucleic acid is free of sequences (preferably protein encoding sequences) which naturally flank the nucleic acid (i.e., sequences located at the 5' and 3' ends of the nucleic acid) in the genomic DNA of the organism from which the nucleic acid is derived. For example, in various embodiments, the isolated FTHMA-070, T85, Tango 77, SPOIL, NEOK-INE, T129 or A259 nucleic acid molecule can contain less than about 5 kb, 4 kb, 3 kb, 2 kb, 1 kb, 0.5 kb or 0.1 kb of nucleotide sequences which naturally flank the nucleic acid molecule in genomic DNA of the cell from which the nucleic acid is derived. Moreover, an "isolated" nucleic acid molecule, such as a cDNA molecule, can be substantially free of other cellular material, or culture medium when produced by recombinant techniques, or substantially free of chemical precursors or other chemicals when chemically synthesized.

A nucleic acid molecule of the present invention, e.g., a nucleic acid molecule having the nucleotide sequence of SEQ ID NOs: 1, 3, 24, 26, 27, 29, 31, 33, 35, 37, 39, 41, 43, 45, 53, 55, 57, 58, 71, 73, 76, 80, 89, 101, 104, 112, 115, 118, 121, 124, 137, 139, 145, 146, 163 or 164 or the nucleotide sequence of the cDNA of a clone deposited with the ATCC® as Accession Number 98348, 98807, 98883, 98984 or 98751 or a complement thereof, can be isolated using standard molecular biology techniques and the sequence information provided herein. Using all or a portion of the nucleic acid sequences of SEQ ID NOs: 1, 3, 24, 26, 27, 29, 31, 33, 35, 37, 39, 41, 43, 45, 53, 55, 57, 58, 71, 73, 76, 80, 89, 101, 104, 112, 115, 118, 121, 124, 137, 139, 145, 146, 163 or 164, or the nucleotide sequence of the cDNA of a clone deposited with the ATCC® as Accession Number 98348, 98807, 98883, 98984 or 98751, as a hybridization probe, nucleic acid molecules of the invention can be isolated using standard hybridization and cloning techniques (e.g., as described in Sambrook et al., eds., *Molecular Cloning: A Laboratory Manual, 2nd ed., Cold Spring Harbor Laboratory*, Cold Spring Harbor Laboratory Press, Cold Spring Harbor, N.Y., 1989).

In another embodiment, a portion of the nucleic acid sequence of SEQ ID NO:89, for example, from nucleotides 1 to 15 or from nucleotides 447 or 495 to 746, can used as a hybridization probe. In yet another embodiment, a portion of the nucleic acid sequence of SEQ ID NO:101, for example, from nucleotides 1 to 280 or from nucleotides 390 to 1291, can be used as a hybridization probe. In yet another embodiment, a portion of the nucleic acid sequence of SEQ ID NO:106, for example, from nucleotides 1-371 or from 481-1377, can be used as a hybridization probe. In yet another embodiment, a portion of the nucleic acid sequence of SEQ ID NO:112, for example, from nucleotides 225-364, from 96-575, or from 495-838, can be used as a hybridization probe.

Moreover, a nucleic acid molecule encompassing all or a portion of SEQ ID NO:89, SEQ ID NO:101, SEQ ID NO:104, SEQ ID NO:112, the DNA insert of the plasmid deposited with ATCC as Accession Number 98883, or the DNA insert of the plasmid deposited with ATCC as Accession Number 98984, can be isolated by the polymerase chain reaction (PCR) using synthetic oligonucleotide primers designed based upon the sequence of SEQ ID NO:89, SEQ ID NO:101, SEQ ID NO:104, SEQ ID NO:112, the DNA insert of the plasmid deposited with ATCC as Accession Number 98883, or the DNA insert of the plasmid deposited with ATCC as Accession Number 98984.

Moreover, a nucleic acid molecule encompassing all or a portion of SEQ ID NO:115, SEQ ID NO:118, SEQ ID NO:121, SEQ ID NO:124, or the nucleotide sequence of the DNA insert of the plasmid deposited with ATCC as Accession Number 98751, can be isolated by the polymerase chain reaction (PCR) using synthetic oligonucleotide primers designed based upon the sequence of SEQ ID NO:115, SEQ ID NO:118, SEQ ID NO:121, SEQ ID NO:124, or the nucleotide sequence of the DNA insert of the plasmid deposited with ATCC as Accession Number 98751.

A nucleic acid molecule of the invention can be amplified using cDNA, mRNA or genomic DNA as a template and appropriate oligonucleotide primers according to standard PCR amplification techniques. The nucleic acid so amplified can be cloned into an appropriate vector and characterized by DNA sequence analysis. Furthermore, oligonucleotides corresponding to all or a portion of a nucleic acid molecule of the invention can be prepared by standard synthetic techniques, e.g., using an automated DNA synthesizer.

In another preferred embodiment, an isolated nucleic acid molecule of the invention comprises a nucleic acid molecule which is a complement of the nucleotide sequence of SEQ ID NOs: 1, 3, 24, 26, 27, 29, 31, 33, 35, 37, 39, 41, 43, 45, 53, 55, 57, 58, 71, 73, 76, 80, 137, 139, 145, 146, 163 or 164, or the nucleotide sequence of the cDNA of a clone deposited with the ATCC® as Accession Number 98348, or 98807, or a portion thereof. A nucleic acid molecule which is complementary to a given nucleotide sequence is one which is sufficiently complementary to the given nucleotide sequence that it can hybridize to the given nucleotide sequence under the conditions set forth herein, thereby forming a stable duplex.

In a preferred embodiment, an isolated nucleic acid molecule of the invention comprises the nucleotide sequence shown in SEQ ID NO:91. The sequence of SEQ ID NO:91 corresponds to murine SPOIL-I cDNA. This cDNA comprises sequences encoding the murine SPOIL-I protein (i.e., "the coding region", from nucleotides 135-428 of SEQ ID NO:89).

In another preferred embodiment, an isolated nucleic acid molecule of the invention comprises the nucleotide sequence shown in SEQ ID NO:92. The sequence of SEQ ID NO:92 corresponds to murine SPOIL-I cDNA. This cDNA comprises sequences encoding the mature SPOIL-I protein (i.e., from nucleotides 186-428 of SEQ ID NO:89 after the signal sequence has been cleaved).

In yet another embodiment, an isolated nucleic acid molecule of the invention comprises the nucleotide sequence shown in SEQ ID NO:89. The sequence of SEQ ID NO:89 corresponds coding and noncoding regions of murine SPOIL-I cDNA. This cDNA comprises sequences encoding the murine SPOIL-I protein (i.e., "the coding region", from nucleotides 135-428) and noncoding regions (i.e., from nucleotides 1-134 and from nucleotides 429-746).

In yet another embodiment, an isolated nucleic acid molecule of the invention comprises the nucleotide sequence shown in SEQ ID NO:112. The sequence of SEQ ID NO:112 corresponds coding and noncoding regions of murine SPOIL-II cDNA. This cDNA comprises sequences encoding the murine SPOIL-II protein (i.e., "the coding region", from nucleotides 96-575) and noncoding regions (i.e., from nucleotides 1-95 and from nucleotides 576-838).

In another preferred embodiment, an isolated nucleic acid molecule of the invention comprises the nucleotide sequence shown in SEQ ID NO:101. The sequence of SEQ ID NO:101 corresponds to the human SPOIL-I cDNA. This cDNA comprises sequences encoding the human SPOIL-I protein (i.e., "the coding region", from nucleotides 124 to 630), as well as 5' untranslated sequences (nucleotides 1 to 123) and 3' untranslated sequences (nucleotides 631 to 1291). Alternatively, the nucleic acid molecule can comprise only the coding region of SEQ ID NO:101 (e.g., nucleotides 124 to 630).

In another preferred embodiment, an isolated nucleic acid molecule of the invention comprises the nucleotide sequence shown in SEQ ID NO:104. The sequence of SEQ ID NO:104 corresponds to the human SPOIL-II cDNA. This cDNA comprises sequences encoding the human SPOIL-II protein (i.e., "the coding region", from nucleotides 98-721, as well as 5' untranslated sequences (nucleotides 1-97 and 3' untranslated sequences (nucleotides 722-1377). Alternatively, the nucleic acid molecule can comprise only the coding region of SEQ ID NO:104 (e.g., nucleotides 98-721).

In another preferred embodiment, an isolated nucleic acid molecule of the invention comprises a nucleic acid molecule which is a complement of the nucleotide sequence shown in SEQ ID NO:89, SEQ ID NO:101, SEQ ID NO:104, SEQ ID NO:112, the DNA insert of the plasmid deposited with ATCC as Accession Number 98883, or the DNA insert of the plasmid deposited with ATCC as Accession Number 98984, or a portion of any of these nucleotide sequences. A nucleic acid molecule which is complementary to the nucleotide sequence shown in SEQ ID NO:89, SEQ ID NO:101, SEQ ID NO:104, SEQ ID NO:112, the DNA insert of the plasmid deposited with ATCC as Accession Number 98883, or the DNA insert of the plasmid deposited with ATCC as Accession Number 98984, is one which is sufficiently complementary to the nucleotide sequence shown in SEQ ID NO:89, SEQ ID NO:101, SEQ ID NO:104, SEQ ID NO:112, the DNA insert of the plasmid deposited with ATCC as Accession Number 98883, or the DNA insert of the plasmid deposited with ATCC as Accession Number 98984, or a complement thereof, thereby forming a stable duplex.

In still another preferred embodiment, an isolated nucleic acid molecule of the present invention comprises a nucleotide sequence which is at least about 50-55%, 60-65%, preferably at least about 70-75%, more preferable at least about 80-85%, and even more preferably at least about 90-95% or more identical to the nucleotide sequences shown in SEQ ID NO:89, the nucleotide sequence shown in SEQ ID NO:101, the nucleotide sequence shown in SEQ ID NO:104, the nucleotide sequence shown in SEQ ID NO:112, the nucleotide sequence of the DNA insert of the plasmid deposited with ATCC as Accession Number 98883, the DNA insert of the plasmid deposited with ATCC as Accession Number 98984, or a portion of any of these nucleotide sequences.

In a preferred embodiment, an isolated nucleic acid molecule of the invention comprises the nucleotide sequence shown in SEQ ID NO:115. The sequence of SEQ ID NO:115 corresponds to the human NEOKINE-1 cDNA. This cDNA comprises sequences encoding the human NEOKINE-1 protein (i.e., "the coding region", from nucleotides 97-393), as well as 5' untranslated sequences (nucleotides 1-97) and 3' untranslated sequences (nucleotides 394-1564). Alternatively, the nucleic acid molecule can comprise only the coding region of SEQ ID NO:115 (e.g., nucleotides 97-393, corresponding to SEQ ID NO:117).

In another preferred embodiment, an isolated nucleic acid molecule of the invention comprises the nucleotide sequence shown in SEQ ID NO:118. The sequence of SEQ ID NO:118 corresponds to a murine NEOKINE-1 cDNA. This cDNA comprises sequences encoding the murine NEOKINE-1 protein (i.e., "the coding region", from nucleotides 212-508), as well as 5' untranslated sequences (nucleotides 1-211) and 3' untranslated sequences (nucleotides 509-1656). Alternatively, the nucleic acid molecule can comprise only the coding region of SEQ ID NO:118 (e.g., nucleotides 212-508, corresponding to SEQ ID NO:120).

In another preferred embodiment, an isolated nucleic acid molecule of the invention comprises the nucleotide sequence shown in SEQ ID NO:121. The sequence of SEQ ID NO:121 corresponds to a rat NEOKINE-1 cDNA. This cDNA comprises sequences encoding at least 79 amino acid residues of the rat NEOKINE-1 protein (i.e., "the coding region", from nucleotides 1-234), as well as 3' untranslated sequences (nucleotides 235-1372). Alternatively, the nucleic acid molecule can comprise only the coding region of SEQ ID NO:121 (e.g., nucleotides 235-1372, corresponding to SEQ ID NO:123).

In another preferred embodiment, an isolated nucleic acid molecule of the invention comprises the nucleotide sequence shown in SEQ ID NO:124. The sequence of SEQ ID NO:124 corresponds to a macaque NEOKINE-1 cDNA. This cDNA comprises sequences encoding at least 94 amino acid residues of the macaque NEOKINE-1 protein (i.e., "the coding region", from nucleotides 3-284), as well as 3' untranslated sequences (nucleotides 285-1458). Alternatively, the nucleic acid molecule can comprise only the coding region of SEQ ID NO:124 (e.g., nucleotides 285-1458, corresponding to SEQ ID NO:136).

In another preferred embodiment, an isolated nucleic acid molecule of the invention comprises a nucleic acid molecule which is a complement of the nucleotide sequence shown in SEQ ID NO:115, SEQ ID NO:118, SEQ ID NO:121, SEQ ID NO:124, or the nucleotide sequence of the DNA insert of the plasmid deposited with ATCC as Accession Number 98751, or a portion of any of these nucleotide sequences. A nucleic acid molecule which is complementary to the nucleotide sequence shown in SEQ ID NO:115, SEQ ID NO:118, SEQ ID NO:121, SEQ ID NO:124, or the nucleotide sequence of the DNA insert of the plasmid deposited with ATCC as Accession Number 98751, is one which is sufficiently complementary to the nucleotide sequence shown in SEQ ID NO:115, SEQ ID NO:118, SEQ ID NO:121, SEQ ID NO:124, or the nucleotide sequence of the DNA insert of the plasmid deposited with ATCC as Accession Number 98751, such that it can hybridize to the nucleotide sequence shown in SEQ ID NO:115, SEQ ID NO:118, SEQ ID NO:121, SEQ ID NO:124, or the nucleotide sequence of the DNA insert of the plasmid deposited with ATCC as Accession Number 98751, thereby forming a stable duplex.

In still another preferred embodiment, an isolated nucleic acid molecule of the present invention comprises a nucleotide sequence which is at least about 60-65%, preferably at least about 70-75%, more preferable at least about 80-85%, and even more preferably at least about 90-95%, 96-97%, 98-99% or more homologous to the nucleotide sequences shown in SEQ ID NO:115, SEQ ID NO:118, SEQ ID NO:121, SEQ ID NO:124, or the nucleotide sequence of the DNA insert of the plasmid deposited with ATCC as Accession Number 98751, or a portion of any of these nucleotide sequences.

Moreover, a nucleic acid molecule of the invention can comprise only a portion of a nucleic acid sequence encoding a full-length polypeptide of the invention for example, a fragment which can be used as a probe or primer or a fragment encoding a biologically active portion of a polypeptide of the invention. The nucleotide sequence determined from the cloning one gene allows for the generation of probes and primers designed for use in identifying and/or cloning homologs in other cell types, e.g., from other tissues, as well as homologs from other mammals. The probe/primer typically comprises substantially purified oligonucleotide.

The oligonucleotide typically comprises a region of nucleotide sequence that hybridizes under stringent conditions to at least about 12, preferably about 25, more preferably about 50, 75, 100, 125, 150, 175, 200, 250, 300, 350 or 400 consecutive nucleotides of the sense or anti-sense sequence of SEQ ID NOs: 1, 3, 24, 26, 27, 29, 31, 33, 35, 37, 39, 41, 43 or 45, or the nucleotide sequence of the cDNA of a clone deposited with the ATCCC as Accession Number 98348, or of a naturally-occurring mutant of SEQ ID NOs: 1, 3, 24, 26, 27, 29, 31, 33, 35, 37, 39, 41, 43 or 45, or the nucleotide sequence of the cDNA of a clone deposited with the ATCC® as Accession Number 98348.

The oligonucleotide typically comprises a region of nucleotide sequence that hybridizes under stringent conditions to at least about 12, preferably about 25, more preferably about 50, 75, 100, 125, 150, 175, 200, 250, 300, 350 or 400 consecutive nucleotides of the sense or anti-sense sequence of SEQ ID NO:53, SEQ ID NO:55, SEQ ID NO:57, SEQ ID NO:58, or of a naturally occurring mutant of SEQ ID NO:53, SEQ ID NO:55, SEQ ID NO:57, SEQ ID NO:58.

The oligonucleotide typically comprises a region of nucleotide sequence that hybridizes under stringent conditions to at least about 12, preferably about 25, more preferably about 50, 75, 100, 125, 150, 175, 200, 250, 300, 350 or 400 consecutive nucleotides of the sense or anti-sense sequence of SEQ ID NO:71, SEQ ID NO:73, SEQ ID NO:76, SEQ ID NO:80, or the cDNA of ATCC 98807. Alternatively, the oligonucleotide can typically comprise a region of nucleotide sequence that hybridizes under stringent conditions to at least about 12, preferably about 25, more preferably about 50, 75, 100, 125, 150, 175, 200, 250, 300, 350 or 400 consecutive nucleotides of the sense or anti-sense sequence of a naturally occurring mutant of SEQ ID NO:71, SEQ ID NO:73, SEQ ID NO:76, SEQ ID NO:80, or the cDNA of ATCC 98807.

The oligonucleotide typically comprises a region of nucleotide sequence that hybridizes under stringent conditions to at least about 12, preferably about 25, more preferably about 40, 50 or 75 consecutive nucleotides of a sense sequence of SEQ ID NO:89, SEQ ID NO: 101, SEQ ID NO:104, SEQ ID NO:112, the DNA insert of the plasmid deposited with ATCC as Accession Number 98883, or the DNA insert of the plasmid deposited with ATCC as Accession Number 98984, of an anti-sense sequence of SEQ ID NO:89, SEQ ID NO:101, SEQ ID NO:104, SEQ ID NO:112, the DNA insert of the plasmid deposited with ATCC as Accession Number 98883, or the DNA insert of the plasmid deposited with ATCC as Accession Number 98984, or of a naturally occurring mutant of either SEQ ID NO:89, SEQ ID NO:101, SEQ ID NO:104, SEQ ID NO:112, the DNA insert of the plasmid deposited with ATCC as Accession Number 98883, or the DNA insert of the plasmid deposited with ATCC as Accession Number 98984.

The oligonucleotide typically comprises a region of nucleotide sequence that hybridizes under stringent conditions to at least about 12, preferably about 25, more preferably about 40, 50 or 75 consecutive nucleotides of a sense sequence of SEQ ID NO:115, SEQ ID NO:118, SEQ ID NO:121, SEQ ID NO:124, or the nucleotide sequence of the DNA insert of the plasmid deposited with ATCC as Accession Number 98751, of an anti-sense sequence of SEQ ID NO:115, SEQ ID NO:118, SEQ ID NO: 121, SEQ ID NO:124, or the nucleotide sequence of the DNA insert of the plasmid deposited with ATCC as Accession Number 98751, or of a naturally occurring mutant of SEQ ID NO:115, SEQ ID NO:118, SEQ ID NO:121, SEQ ID NO:124, or the nucleotide sequence of the DNA insert of the plasmid deposited with ATCC as Accession Number 98751. In an exemplary embodiment, a nucleic acid molecule of the present invention comprises a nucleotide sequence which is greater that 500 nucleotides in length and hybridizes under stringent hybridization conditions to a nucleic acid molecule of SEQ ID NO:115, SEQ ID NO:118, SEQ ID NO:121, SEQ ID NO:124, or the nucleotide sequence of the DNA insert of the plasmid deposited with ATCC as Accession Number 98751.

The oligonucleotide typically comprises a region of nucleotide sequence that hybridizes under stringent conditions to at least about 12, preferably about 25, more preferably about 50, 75, 100, 125, 150, 175, 200, 250, 300, 350 or 400 consecutive nucleotides of the sense or anti-sense sequence of SEQ ID NO:137 or SEQ ID NO:139, or of a naturally occurring mutant of SEQ ID NO:137 or SEQ ID NO:139.

The oligonucleotide typically comprises a region of nucleotide sequence that hybridizes under stringent conditions to at least about 12, preferably about 25, more preferably about 50, 75, 100, 125, 150, 175, 200, 250, 300, 350 or 400 consecutive nucleotides of the sense or anti-sense sequence of SEQ ID NO:145, 146, 163, or 164 or of a naturally occurring mutant of SEQ ID NO: 145, 146, 163, or 164.

Probes based on the sequence of a nucleic acid molecule of the invention can be used to detect transcripts or genomic sequences encoding the same protein molecule encoded by a selected nucleic acid molecule. The probe comprises a label group attached thereto, e.g., a radioisotope, a fluorescent compound, an enzyme, or an enzyme co-factor. Such probes can be used as part of a diagnostic test kit for identifying cells or tissues which mis-express the protein, such as by measuring levels of a nucleic acid molecule encoding the protein in a sample of cells from a subject, e.g., detecting mRNA levels or determining whether a gene encoding the protein has been mutated or deleted.

A nucleic acid fragment encoding a biologically active portion of a polypeptide of the invention can be prepared by isolating a portion of any of SEQ ID NOs: 2, 25, 28, 30, 32, 34, 36, 38, 40, 42, 44 or 46, or the amino acid sequence encoded by the cDNA of a clone deposited with the ATCC® as Accession Number 98348 expressing the encoded portion of the polypeptide protein (e.g., by recombinant expression in vitro) and assessing the activity of the encoded portion of the polypeptide.

A nucleic acid fragment encoding a "biologically active portion of FTHMA-070, Tango85, Tango77, SPOIL, NEOKINE, Tango129 or A259" can be prepared by isolating a portion of SEQ ID NO:53, 55, 57, 58, 71, 73, 76, 80, 89, 101, 104, 112, 115, 118, 121, 124, 137, 139, 146 or 164, or the nucleotide sequence of the cDNA of ATCC 98807, 98883, 98984 or 98751, which encodes a polypeptide having a FTHMA-070, Tango85, Tango77, SPOIL, NEOKINE, Tango129 or A259 biological activity, expressing the encoded portion of FTHMA-070, Tango85, Tango77, SPOIL, NEOKINE, Tango129 or A259 protein (e.g., by recombinant expression in vitro) and assessing the activity of the encoded portion of FTHMA-070, Tango85, Tango77, SPOIL, NEOKINE, Tango 129 or A259.

The invention further encompasses nucleic acid molecules that differ from the nucleotide sequence of SEQ ID NOs: 1, 3, 24, 26, 27, 29, 31, 33, 35, 37, 39, 41, 43, 45, 53, 55, 57, 58, 71, 73, 76, 80, 89, 101, 104, 112, 115, 118, 121, 124, 137, 139, 145, 146, 163 or 164, or the nucleotide sequence of the cDNA of a clone deposited with the ATCC® as Accession Number 98348, 98807, 98883, 98984 or 98751, due to degeneracy of the genetic code and thus encode the same protein as that encoded by the nucleotide sequence of SEQ ID NOs: 1, 3, 24, 26, 27, 29, 31, 33, 35, 37, 39, 41, 43, 45, 53, 55, 57, 58, 71, 73, 76, 80, 89, 101, 104, 112, 115, 118, 121, 124, 137, 139, 145, 146, 163 or 164, or the nucleotide sequence of the cDNA of a clone deposited with the ATCC® as Accession Number 98348, 98807, 98883, 98984 or 98751.

In addition to the nucleotide sequences of SEQ ID NOs: 1, 3, 24, 26, 27, 29, 31, 33, 35, 37, 39, 41, 43, 45, 53, 55, 57, 58, 71, 73, 76, 80, 89, 101, 104, 112, 115, 118, 121, 124, 137, 139, 145, 146, 163 or 164, or the nucleotide sequence of the cDNA of a clone deposited with the ATCC® as Accession Number 98348, 98807, 98883, 98984 or 98751, it will be appreciated by those skilled in the art that DNA sequence polymorphisms that lead to changes in the amino acid sequence may exist within a population (e.g., the human population). Such genetic polymorphisms may exist among individuals within a population due to natural allelic variation.

Such allelic variants of a polymorphic region of a Delta3 gene are also included as part of the present invention. For example, the human gene for Delta3 was mapped to chromosome 15, between markers D15S1244 and D 15S144, and therefore, human Delta3 family members can include nucleotide sequence polymorphisms (e.g., nucleotide sequences that vary from SEQ ID NO: 1, 3, 24, 26, 27, 29, 31, 33, 35, or 37) that map to this chromosome 15 region (i.e., between framework regions D15S1244 and D15S144), as well as polypeptides encoded therefrom.

An allele is one of a group of genes which occur alternatively at a given genetic locus. As used herein, the terms "gene" and "recombinant gene" refer to nucleic acid molecules comprising an open reading frame encoding a Delta3, FTHMA-070, Tango85, Tango77, SPOIL, NEOKINE, Tango129 or A259 protein, preferably a mammalian Delta3, FTHMA-070, Tango85, Tango77, SPOIL, NEOKINE, Tango129 or A259 protein. Such natural allelic variations can typically result in 1-5% variance in the nucleotide sequence of a given gene. Alternative alleles can be identified by sequencing the gene of interest in a number of different individuals. This can be readily carried out by using hybridization probes to identify the same genetic locus in a variety of individuals. Any and all such nucleotide variations and resulting amino acid polymorphisms or variations that are the result of natural allelic variation and that do not alter the functional activity are intended to be within the scope of the invention.

In addition to naturally-occurring allelic variants of a nucleic acid molecule of the invention sequence that may exist in the population, the skilled artisan will further appreciate that changes can be introduced by mutation thereby leading to changes in the amino acid sequence of the encoded protein, without altering the biological activity of the protein. For example, one can make nucleotide substitutions leading to amino acid substitutions at "non-essential" amino acid residues. A "non-essential" amino acid residue is a residue that can be altered from the wild-type sequence without altering the biological activity, whereas an "essential" amino acid residue is required for biological activity. For example, amino acid residues that are not conserved or only semi-conserved among homologs of various species may be non-essential for activity and thus would be likely targets for alteration. Alternatively, amino acid residues that are conserved among the orthologs of various species (e.g., murine and human) may be essential for activity and thus would not be likely targets for alteration.

In one embodiment of a nucleotide sequence of human Delta3, the nucleotide at position 786 is an cytosine (C) (SEQ ID NO: 1). In this embodiment, the amino acid at position 150 is a alanine (A) (SEQ ID NO: 2). In an alternative embodiment, a species variant of human Delta3 has a nucleotide at position 786 which is a thymidine (T) (SEQ ID NO: 33). In this embodiment, the amino acid at position 150 is valine (V) (SEQ ID NO: 34), i.e., a conservative substitution.

In one embodiment of a nucleotide sequence of human Delta3, the nucleotide at position 594 is a cytosine (C) (SEQ ID NO: 1). In this embodiment, the amino acid at position 86 is threonine (T) (SEQ ID NO: 2). In an alternative embodiment, a species variant of human Delta3 has a nucleotide at position 594 which is a guanine (G) (SEQ ID NO: 35). In this embodiment, the amino acid at position 86 is serine (S) (SEQ ID NO: 36), i.e., a conservative substitution.

In one embodiment of a nucleotide sequence of human Delta3, wherein the nucleotide at position 883 is a thymidine (T) (SEQ ID NO: 1). In this embodiment, the amino acid at position 182 is aspartate (D) (SEQ ID NO: 2). In an alternative embodiment, a species variant of human Delta3 has a nucleotide at position 883 which is an adenine (A) (SEQ ID NO: 37). In this embodiment, the amino acid at position 182 is glutamate (E) (SEQ ID NO: 38), i.e., a conservative substitution.

In one embodiment of a nucleotide sequence of mouse Delta3, the nucleotide at position 49 is cytosine (C) (SEQ ID NO: 24). In this embodiment, the amino acid at position 4 is alanine (A) (SEQ ID NO: 25). In an alternative embodiment, a species variant of mouse Delta3 has a nucleotide at position 49 which is thymidine (T) (SEQ ID NO: 39). In this embodiment, the amino acid at position 4 is valine (V) (SEQ ID NO: 40), i.e., a conservative substitution.

In one embodiment of a nucleotide sequence of mouse Delta3, the nucleotide at position 51 is thymidine (T) (SEQ ID NO: 24). In this embodiment, the amino acid at position 5 is serine (S) (SEQ ID NO: 25). In an alternative embodiment, a species variant of mouse Delta3 has a nucleotide at position 51 which is a adenine (A) (SEQ ID NO: 41). In this embodiment, the amino acid at position 5 is threonine (T) (SEQ ID NO: 42), i.e., a conservative substitution.

In one embodiment of a nucleotide sequence of mouse Delta3, the nucleotide at position 109 is guanine (G) (SEQ ID NO: 24). In this embodiment, the amino acid at position 24 is arginine (R) (SEQ ID NO: 25). In an alternative embodiment, a species variant of mouse Delta3 has a nucleotide at position 109 which is adenine (A) (SEQ ID NO: 43). In this embodiment, the amino acid at position 24 is histidine (H) (SEQ ID NO: 44), i.e., a conservative substitution.

In one embodiment of a nucleotide sequence of mouse Delta3, wherein the nucleotide at position 130 is a thymidine (T) (SEQ ID NO: 24). In this embodiment, the amino acid at position 31 is phenylalanine (F) (SEQ ID NO: 25). In an alternative embodiment, a species variant of mouse Delta3 has a nucleotide at position 130 which is adenine (A) (SEQ ID NO: 45). In this embodiment, the amino acid at position 31 is tyrosine (Y) (SEQ ID NO: 46), i.e., a conservative substitution.

The invention also pertains to nucleic acid molecules encoding a polypeptide of the invention that contain changes in amino acid residues that are not essential for activity. Such polypeptides differ in amino acid sequence from SEQ ID NOs: 2, 25, 28, 30, 32, 34, 36, 38, 40, 42, 44 or 46, or the amino acid sequence encoded by the cDNA of a clone deposited with the ATCC® as Accession Number 98348 yet retain biological activity. In one embodiment, the isolated nucleic acid molecule includes a nucleotide sequence encoding a protein that includes an amino acid sequence that is at least 65%, 75%, 85%, 95%, or 98% identical to the amino acid sequence of SEQ ID NOs: 2, 25, 28, 30, 32, 34, 36, 38, 40, 42, 44 or 46, or the amino acid sequence encoded by the cDNA of a clone deposited with the ATCC® as Accession Number 98348.

Moreover, nucleic acid molecules encoding proteins of the invention from other species (homologs), which have a nucleotide sequence which differs from that of the human protein described herein are intended to be within the scope of the invention. Nucleic acid molecules corresponding to natural allelic variants and homologs of a cDNA of the invention can be isolated based on their identity to the human nucleic acid molecule disclosed herein using the human cDNAs, or a portion thereof, as a hybridization probe according to standard hybridization techniques under stringent hybridization conditions. For example, a cDNA encoding a soluble form of a membrane-bound protein of the invention isolated based on its hybridization to a nucleic acid molecule encoding all or part of the membrane-bound form. Likewise, a cDNA encoding a membrane-bound form can be isolated based on its hybridization to a nucleic acid molecule encoding all or part of the soluble form.

As used herein, the term "hybridizes under stringent conditions" is intended to describe conditions for hybridization and washing under which nucleotide sequences at least 60% (65%, 70%, preferably 75%) identical to each other typically remain hybridized to each other. Such stringent conditions are known to those skilled in the art and can be found in *Current Protocols in Molecular Biology*, John Wiley & Sons, N.Y. (1989), 6.3.1-6.3.6. A preferred, non-limiting example of stringent hybridization conditions are hybridization in 6× sodium chloride/sodium citrate (SSC) at about 45° C., followed by one or more washes in 0.2×SSC, 0.1% SDS at 50-65° C. Preferably, an isolated nucleic acid molecule of the invention that hybridizes under stringent conditions to the sequence of SEQ ID NOs: 1, 3, 24, 26, 27, 29, 31, 33, 35, 37, 39, 41, 43, 45, 53, 55, 57, 58, 71, 73, 76, 80, 89, 101, 104, 112, 115, 118, 121, 124, 137, 139, 145, 146, 163 or 164, or the cDNA of ATCC® as Accession Number 98348, 98807, 98883, 98984 or 98751 corresponds to a naturally-occurring nucleic acid molecule. As used herein, a "naturally-occurring" nucleic acid molecule refers to an RNA or DNA molecule having a nucleotide sequence that occurs in nature (e.g., encodes a natural protein).

Accordingly, in another embodiment, an isolated nucleic acid molecule of the invention is at least 480 (500, 550, 600, 650, 700, 800, 900, 1000, 1100, 1200, 1300, 1400, 1500, 1600, 1700, 1800, 1900, 2000 or 2050) nucleotides in length and hybridizes under stringent conditions to the nucleic acid molecule comprising the nucleotide sequence, preferably the coding sequence, of SEQ ID NOs: 1, 3, 24, 26, 27, 29, 31, 33, 35, 37, 39, 41, 43 or 45, or the nucleotide sequence of the cDNA of a clone deposited with the ATCC® as Accession Number 98348, or complement thereof.

Accordingly, in another embodiment, an isolated nucleic acid molecule of the invention is at least 300 (325, 350, 375, 400, 425, 450, 500, 550, 600, 650, 700, 800, 900, 1000, or 1290) nucleotides in length and hybridizes under stringent conditions to the nucleic acid molecule comprising the nucleotide sequence, preferably the coding sequence, of SEQ ID NO:53, 55, 57 or 58.

Accordingly, in another embodiment, an isolated nucleic acid molecule of the invention is at least 300 (325, 350, 375, 400, 425, 450, 500, 550, 600, 650, 700, 800, or 989) nucleotides in length and hybridizes under stringent conditions to the nucleic acid molecule comprising the nucleotide sequence, preferably the coding sequence, of SEQ ID NO:71, 73, 76, 80, or the cDNA of ATCC 98807.

Accordingly, in another embodiment, an isolated nucleic acid molecule of the invention is at least 15 nucleotides in length and hybridizes under stringent conditions to the nucleic acid molecule comprising the nucleotide sequence of SEQ ID NO:89, 101, 104, 112 or the DNA insert of the plasmid deposited with ATCC as Accession Number 98883 or 98984, or a complement thereof. In other embodiments, the nucleic acid is at least 30, 50, 100, 250, 300, 400, 500, 600 or 700 nucleotides in length.

Accordingly, in another embodiment, an isolated nucleic acid molecule of the invention is at least 15 nucleotides in length and hybridizes under stringent conditions to the nucleic acid molecule comprising the nucleotide sequence of SEQ ID NO:115, 118, 121, 124, or the nucleotide sequence of the DNA insert of the plasmid deposited with ATCC as Accession Number 98751. In other embodiment, the nucleic acid is at least 30, 50, 100, 250 or 500 nucleotides in length.

Accordingly, in another embodiment, an isolated nucleic acid molecule of the invention is at least 300 (325, 350, 375, 400, 425, 450, 500, 550, 600, 650, 700, 800, 900, 1000, or 1290) nucleotides in length and hybridizes under stringent conditions to the nucleic acid molecule comprising the nucleotide sequence, preferably the coding sequence, of SEQ ID NO:137 or 139

Accordingly, in another embodiment, an isolated nucleic acid molecule of the invention is at least 400 (450, 500, 550, 600, 650, 700, 800, 900, 1000, 2000, or 3000) nucleotides in length and hybridizes under stringent conditions to the nucleic acid molecule comprising the nucleotide sequence, preferably the coding sequence, of SEQ ID NO:145 or 163, or a complement thereof.

Preferably, such nucleic acid molecules, "specifically hybridize" or "specifically detect" a nucleic acid molecule of the invention by exhibiting the ability to hybridize to at least approximately 6, 12, 20, 30, 50, 100, 150, 200, 300, 350, 400 or 425 consecutive nucleotides of a Delta3 nucleotide sequence designated in one of SEQ ID Nos: 1, 3, 24, 26, 27, 29, 31, 33, 35, 37, 39, 41, 43 or 45, or the nucleotide sequence of the cDNA of a clone deposited with the ATCC® as Accession Number 98348, or a sequence complementary thereto, such that more than 5, 10 or 20 times more hybridization (utilizing hybridization conditions described above), preferably more than 50 times more hybridization, and even more preferably more than 100 times more hybridization than occurs relative to hybridization to a cellular nucleic acid (e.g., mRNA or genomic DNA) encoding a protein other than a Delta3 protein as defined herein.

Delta3 nucleic acids can encode polypeptides that are at least 55% identical to an amino acid sequence of SEQ ID NOs: 2, 25, 28, 30, 32, 34, 36, 38, 40, 42, 44 or 46, or the amino acid sequence encoded by the cDNA of a clone deposited with the ATCC® as Accession Number 98348. Nucleic acids which encode polypeptides which are at least about 72%, and even more preferably at least about 80%, 85%, 90%, 95%, or 98% similar with an amino acid sequence represented in SEQ ID NO: 2, 25, 28, 30, 32, 34, 36, 38, 40, 42, 44 or 46, or the amino acid sequence encoded by the cDNA of a clone deposited with the ATCC® as Accession Number 98348 are also within the scope of the invention.

In one embodiment, the nucleic acid of the present invention encodes a polypeptide having an overall amino acid sequence similarity of at least about 72%, at least about 80%, at least about 85%, at least about 90%, at least about 95%, at least about 98%, or at least about 99% with the amino acid sequence shown in SEQ ID NOs: 2, 25, 28, 30, 32, 34, 36, 38, 40, 42, 44 or 46. In a preferred embodiment, the nucleic acid encodes a protein comprising the amino acid set forth in SEQ ID NOs: 2, 25, 28, 30, 32, 34, 36, 38, 40, 42, 44 or 46, or the amino acid sequence encoded by the cDNA of a clone deposited with the ATCC® as Accession Number 98348. Preferably, the nucleic acid includes all or a portion of the nucleotide sequence corresponding to the coding region of SEQ ID Nos: 1, 3, 24, 26, 27, 29, 31, 33, 35, 37, 39, 41, 43 or 45, or the nucleotide sequence of the cDNA of a clone deposited with the ATCC® as Accession Number 98348.

The nucleic acids of the invention can encode a Delta3 protein from any species, including insects. Preferred nucleic acids encode vertebrate Delta3 proteins. Even more preferred nucleic acids encode mammalian Delta3 proteins including primate Delta3 proteins, e.g., human Delta3 proteins, and murine Delta3 proteins. Other nucleic acids of the invention can encode avian, equine, canine, feline, bovine or porcine Delta3 proteins.

In a preferred embodiment of the invention, the nucleic acid encodes a polypeptide comprising an extracellular domain of Delta3, e.g., human or mouse Delta3 including allelic variants having SEQ ID NOs: 2, 25, 28, 30, 32, 34, 36, 38, 40, 42, 44 or 46, or the amino acid sequence encoded by the cDNA of a clone deposited with the ATCC® as Accession Number 98348. Accordingly, preferred nucleic acids encode a polypeptide comprising about amino acid 1 to about amino acid 529 of SEQ ID NO: 2, 28, 30, 32, 34, 36 or 38, or alternatively about amino acid 1 to about amino acid 530 of SEQ ID NO: 25, 40, 42, 44, or 46.

Other preferred nucleic acids encode a polypeptide corresponding to an extracellular domain of Delta3 lacking the signal peptide, e.g., a polypeptide comprising about amino acid 18 to about amino acid 529 of SEQ ID NO: 2 or about amino acid 18 to about amino acid 530 of SEQ ID NO: 25. Yet other preferred nucleic acids encode a polypeptide comprising at least one of the conserved motifs in the extracellular domain of Delta3, e.g., a DSL motif (for example, amino acids 173-217 of SEQ ID NO: 2 or amino acids 174-218 of SEQ ID NO: 25) or an EGF-like motif (for example, EGF-like 1, amino acids 222-250 of SEQ ID NO: 2), or also for example amino acids 223-251 of SEQ ID NO: 25. Additional EGF-like domains are from amino acids 253-281, 288-321, 328-359, 366-399, 411-437, 444-475, and 484-517 of SEQ ID NO: 2 and 254-282, 289-322, 329-360, 367-400, 412-438, 445-476, and 485-518 of SEQ ID NO: 25.

In one embodiment, the nucleic acid encodes a protein having at least one EGF-like motif. In other embodiments, the nucleic acid encodes proteins having at least 2, at least 3, at least 4, at least 5, at least 6, at least 7, or 8 EGF-like domains or amino acids 223-251, 254-282, 289-322, 329-360, 367-400, 412-438, 445-476, and 485-518 of SEQ ID NO: 25.

The polypeptide encoded by a nucleic acid encoding any of these numbers of EGF-like domains can further comprise an amino acid sequence encoding a DSL motif.

The DSL region or motif is shared by all known members of the family of presumed ligands of Notch-like proteins (Delta1 and Serrate in *Drosophila*; Lag-2 and Apx-1 in *Caenorhabditis elegans*) (Henderson et al. (1994) Development 120:2913; Tax et al. (1994) Nature 368:150; Fleming et al. (1990) Genes Dev. 4:2188; Thomas et al. (1991) Development 11:749; Mello et al. (1994) Cell 77:95). The DSL motif is located in the amino terminal portion of the protein, i.e., extracellular, which is closely related to a similar domain in the *Drosophila* Delta1 protein and which has been described as being necessary and sufficient for in vitro binding to Notch (Henrique et al. (1995) Nature 375:787; Muskavitch (1994) Dev. Biol. 166:415).

In one embodiment, a nucleic acid of the invention encodes a polypeptide that comprises a human or mouse Delta3 DSL domain and which is capable of binding a receptor. A Delta3 DSL domain conforms to the following DSL consensus sequence: X—X—C—X—X—X—Y—[FY]-G-X—X—C—X—X—X—C—[HR]—X—R—X-D-X—F-G-[RH]— X—X—C—X—X—X-G-X—X—X—C—X—X-G-W— X-G-X—Y—C (SEQ ID NO:23), wherein all amino acids are indicated according to their universal single letter designation, brackets indicate that the amino acid at that position is selected from one of the amino acids within the brackets, and "X" designates any amino acid, and wherein the DSL domain is at least 60%, or more preferably at least 65%, 70%, 75%, 80%, 85%, or most preferably 90%, 95%, 98% or 100% identical, i.e., no gaps in the sequence, to the human Delta3 polypeptide sequence from amino acids 173-217 of SEQ ID NO:2. In another embodiment, a Delta3 DSL domain conforms to the above-described DSL consensus sequence and is at least 60%, or more preferably at least 65%, 70%, 75%, 80%, 85%, or most preferably 90%, 95%, 98% or 100% identical to the mouse Delta3 DSL sequence from amino acids 174-218 of SEQ ID NO: 25.

In another embodiment, a nucleic acid of the invention encodes Delta3 DSL domain has a cysteine at amino acid positions 176, 185, 189, 201, 209, and 217 of SEQ ID NO: 2, and is at least 60%, or more preferably at least 65%, 70%, 75%, 80%, 85%, or most preferably 90%, 95%, 98% or 100% identical to the human Delta3 polypeptide sequence from amino acids 173-217 of SEQ ID NO:2. In another embodiment, a Delta3 DSL domain has a cysteine at amino acid positions 177, 186, 190, 202, 210, and 218 of SEQ ID NO: 25, and is at least 60%, or more preferably at least 65%, 70%, 75%, 80%, 85%, or most preferably 90%, 95%, 98% or 100% identical to the mouse Delta3 DSL sequence from amino acids 174-218 of SEQ ID NO: 25.

In one embodiment, a nucleic acid of the invention encodes a polypeptide that comprises a human or mouse Delta3 EGF-like domain. An EGF-like domain has the following consensus sequence: C—$X_{4-8}$—C—$X_{1-2}$-G-X—C—$X_{5-9}$-[WFY]—X—C—X—C—$X_2$4-G-[WFY]-G-$X_{1-3}$— [FY]—C (SEQ ID NO:52), wherein all amino acids are indicated according to their universal single letter designation, brackets indicate that the amino acid at that position is selected from one of the amino acids within the brackets, and "X" designates any amino acid. The numbers in subscript next to an amino acid position indicate a range of possible amino acids, for example, C—$X_{5-9}$—C indicates that there is a cysteine followed by any 5 to 9 amino acids followed by a cysteine. In one embodiment, an EGF-like domain of the invention is at least 75%, or more preferably at least 80%, 85%, or most preferably 90%, 95%, 98% or 100% identical, i.e., no gaps in the sequence, to the human Delta3 polypeptide sequence from amino acids 222-250, amino acids 253-281, amino acids 288-321, amino acids 328-359, amino acids 366-399, amino acids 411-437, amino acids 444-475, and amino acids 484-517 of SEQ ID NO: 2. In another preferred embodiment, a Delta3 EGF-like domain conforms to the above-described EGF-like consensus sequence and is at least 60%, or more preferably at least 75%, 80%, 85%, or most preferably 90%, 95%, 98% or 100% identical to the mouse Delta3 DSL sequence from amino acids 223-251, amino acids 254-282, amino acids 289-322, amino acids 329-360, amino acids 367-400, amino acids 412-438, amino acids 445-476, and amino acids 485-518 of SEQ ID NO: 25.

In another embodiment, a nucleic acid of the invention encodes Delta3 EGF-like domain is at least 75%, or more preferably at least 80%, 85%, or most preferably 90%, 95%, 98% or 100% identical to the human Delta3 polypeptide sequence from amino acids 222-250, amino acids 253-281, amino acids 288-321, amino acids 328-359, amino acids 366-399, amino acids 411-437, amino acids 444-475, or amino acids 484-517 of SEQ ID NO: 2. In another embodiment, a Delta3 EGF-like domain is at least 75%, or more preferably at least 80%, 85%, or most preferably 90%, 95%, 98% or 100% identical to the mouse Delta3 EGF-like domain sequence from amino acids 223-251, amino acids 254-282, amino acids 289-322, amino acids 329-360, amino acids 367-400, amino acids 412-438, amino acids 445-476, or amino acids 485-518 of SEQ ID NO: 25.

Polypeptides encoded by any of the above-described nucleic acids can be soluble. Preferred soluble peptides comprise at least a portion of the extracellular domain of a Delta3 protein. Even more preferred soluble polypeptides comprise an amino acid sequence corresponding to about amino acid 1 to about amino acid 529 of SEQ ID NO: 2, corresponding to about amino acid 18 to about amino acid 529 of SEQ ID NO: 2 or a homolog thereof. Alternatively, an extracellular domain is comprised of about amino acid 1 to about amino acid 530 of SEQ ID NO: 25, about amino acid 18 to about amino acid 530 of SEQ ID NO: 25 or a homolog thereof.

Yet other preferred soluble Delta3 polypeptides comprise at least one EGF-like domain. Such polypeptides may in addition comprise a DSL domain and optionally a signal peptide.

In another embodiment, nucleic acids encode a Delta3 polypeptide as part of a fusion protein. A preferred fusion protein is a Delta3 Immunoglobulin (Ig) fusion protein, or alternatively, a Delta3 portion as described above fused to Ig. Such fusion proteins can comprise at least a portion of the extracellular domain of a Delta3 domain. A portion can be any portion of at least about 10 amino acids, such as the portions described above. Nucleic acids encoding such fusion proteins can be prepared, e.g., as described in U.S. Pat. No. 5,434,131.

Alternatively, polypeptides encoded by the nucleic acid of the invention can be membrane bound. Membrane bound polypeptides of the invention preferably comprise a transmembrane domain. As used herein, a "transmembrane domain" refers to an amino acid sequence having at least about 20 to 25 amino acid residues in length and which contains at least about 65-70% hydrophobic amino acid residues such as alanine, leucine, isoleucine, phenylalanine, proline, tyrosine, tryptophan, or valine. The transmembrane domain can be from a Delta3 protein, such as a transmembrane domain comprising amino acid 530 to amino acid 553 of SEQ ID NO: 2, or amino acid 531 to amino acid 554 of SEQ ID NO: 25.

In a one embodiment, a nucleic acid of the invention encodes transmembrane domain contains at least about 15 to 30 amino acid residues, preferably about 20-25 amino acid residues, and has at least about 60-80%, more preferably 65-75%, and more preferably at least about 70% hydrophobic residues from about amino acid 530 to about amino acid 553 of SEQ ID NO: 2, or from about amino acid 531 to about amino acid 554 of SEQ ID NO: 25.

Alternatively, the transmembrane domain can be from another membrane protein, such as to produce a chimeric membranous Delta3 protein. Yet other polypeptides of the invention can be intracellular proteins. Accordingly, also within the scope of the invention are proteins which do not comprise a transmembrane domain. Other proteins of the invention do not include an extracellular domain. Additional proteins of the invention do not include an extracellular domain nor a transmembrane domain.

Polypeptides encoded by the nucleic acid of the invention can comprise a cytoplasmic domain. In a preferred embodiment, a nucleic acid of the invention encodes a polypeptide comprising a Delta3 cytoplasmic domain. In an even more preferred embodiment, the cytoplasmic domain has an amino acid sequence corresponding to a sequence from about amino acid 554 to about amino acid 685 of SEQ ID NO: 2, or a portion thereof, or from about amino acid 555 to about amino acid 686 of SEQ ID NO: 25.

In yet other preferred embodiments, the nucleic acid of the invention encodes a polypeptide comprising at least one domain of a Delta3 protein selected from the group consisting of: a signal peptide, a DSL motif, an EGF-like domain, a transmembrane domain, and a cytoplasmic domain. The polypeptide of the invention can comprise several of these domains from a Delta3 protein.

Alternatively, a nucleic acid of the invention encodes a polypeptide that can be a chimeric protein, i.e., comprised of at least one conserved domain of SEQ ID NO: 2, 25, 2, 25, 28, 30, 32, 34, 36, 38, 40, 42, 44 or 46, or the amino acid sequence encoded by the cDNA of a clone deposited with the ATCC® as Accession Number 98348 and at least one conserved domain from a polypeptide other than a Delta3 protein. Accordingly, in one embodiment, a nucleic acid of the invention encodes a Delta3 polypeptide of 2, 25, 28, 30, 32, 34, 36, 38, 40, 42, 44 or 46, or the amino acid sequence encoded by the cDNA of a clone deposited with the ATCC® as Accession Number 98348 wherein, for example, the DSL motif from amino acids 173-217 of SEQ ID NO: 2, are replaced with amino acids from a comparable DSL domain of a Delta-like protein other than Delta3.

In yet another embodiment, the nucleic acid encodes a Delta3 protein having a signal peptide from a protein other than a Delta3 protein. Also within the scope of the invention are Delta3 nucleic acids which encode a Delta3 polypeptide, wherein the cytoplasmic domain is other than a Delta3 cytoplasmic domain. In addition, the invention contemplates a Delta3 nucleic acid molecule, wherein the nucleic acid encodes a Delta3 polypeptide with a cytoplasmic domain and a extracellular domain from a protein other than Delta3.

Delta-like proteins other than Delta3 proteins can be, e.g., toporythmic proteins. "Toporythmic proteins" is intended to include Notch, Delta, Serrate, Enhancer of Split, Deltex, and other members of this family of proteins sharing structural similarities. (See e.g., International Patent Publication Nos. WO 97/01571 (Jan. 16, 1997); WO 92/19734 (Nov. 12, 1992) and WO 94/07474 (Apr. 14, 1994)).

Nucleic acids encoding polypeptides having an amino acid sequence that is homologous to any of the above described portions of SEQ ID NO: 2, 25, 28, 30, 32, 34, 36, 38, 40, 42, 44 or 46, or the amino acid sequence encoded by the cDNA of a clone deposited with the ATCC® as Accession Number 98348 are also within the scope of the invention. Preferred nucleic acids of the invention encode polypeptides comprising an amino acid sequence which are at least about 70%, at least about 75%, at least about 80%, or at least about 85% identical to the amino acid sequence of any of the Delta3 domains. Even more preferred nucleic acids of the invention encode polypeptides comprising an amino acid sequence which are at least about 90%, at least about 95%, at least about 98%, or at least about 99% identical to the amino acid sequence of any of the Delta3 domains.

In one embodiment, the nucleic acid, e.g., cDNA, encodes a peptide having at least one activity of the subject Delta3 polypeptide, such as the ability to bind to a Delta3 interacting molecule, such as a Delta3 receptor e.g., Notch. Non-limiting examples of binding assays for Delta3 interaction with a Delta3 interacting molecule include: measuring interaction of Delta3 polypeptides of the invention with a Delta3 interacting molecule, such as for example Notch, include binding assays involving soluble forms of Delta3 and a Delta3 interacting molecule, measuring a Delta3 domain, e.g., the DSL domain, binding to a Delta3 interacting molecule, measuring Delta3 binding to receptors expressed on cells, and measuring soluble Delta3 binding to an immobilized Delta3 interacting molecule, i.e., solid-phase binding assays. Specific examples of these assays are set forth in Shimizu et al. (1999) *J. Biol. Chem.* 274:32961-32969.

Additional molecules, e.g., polypeptides or peptides, capable of interacting with a Delta3 protein or fragment thereof can be identified by various methods, e.g., methods based on binding assays. For example, various types of expression libraries can be screened with a Delta3 protein or portion thereof. A two-hybrid system can be used to isolate cytoplasmic proteins interacting with the cytoplasmic domain of Delta3. Portions of Delta3 proteins which are capable of interacting with a ligand can be determined by preparing fragments of Delta3 proteins and screening these fragments for those that are capable of interacting with the ligand.

Based at least in part on the observation that the N-terminal portion of *Drosophila* Delta protein, which contains a DSL domain and EGF-like domain, is necessary and sufficient for in vitro binding to Notch (Henrique et al. (1995) *Nature* 375:787; Muskavitch (1994) *Dev. Biol.* 166:415), it is likely that the domain of Delta3 proteins capable of interacting with a ligand includes the DSL domain and/or at least a portion of the EGF-like domain. However, other portions of the extracellular domain of Delta3 could be necessary for binding to at least some Delta3 ligands.

In other preferred embodiments, the subject Delta3 polypeptide can modulate proliferation and/or differentiation or cell death of specific target cells, e.g., neural cells or endothelial cells. Assays for determining that a Delta3 polypeptide has at least one activity of a Delta3 protein are described infra.

Still other preferred nucleic acids of the present invention encode a Delta3 polypeptide which includes a polypeptide sequence corresponding to all or a portion of amino acid residues in SEQ ID NO: 2, 25, 28, 30, 32, 34, 36, 38, 40, 42, 44 or 46, e.g., at least 2, 5, 10, 25, 50, 100, 150 or 200 amino acid residues of that region. Preferred nucleic acids encode a polypeptide comprising at least two consecutive amino acid residues from about amino acid 1 to about amino acid 570 of the amino acid sequence set forth in SEQ ID NO: 2 or from about amino acid 1 to about amino acid 571 of the amino acid sequence set forth in SEQ ID NO: 25.

Yet other preferred nucleic acids encode a polypeptide comprising at least about 3, at least about 5, at least about 10, at least about 15, at least about 20, or at least about 25 consecutive amino acids from about amino acid 1 to about amino acid 575 set forth in SEQ ID NO: 2, from about amino acid 18 to about amino acid 575 set forth in SEQ ID NO: 2, from about amino acid 1 to about amino acid 576 set forth in SEQ ID NO: 25, or from about amino acid 18 to about amino acid 576 set forth in SEQ ID NO: 25.

The invention further provides for nucleic acids encoding a polypeptide having an amino acid sequence which is at least about 70%, preferably at least about 80%, and most preferably at least about 90% to at least about 10 consecutive amino acids set forth in SEQ ID NOs: 2, 25, 28, 30, 32, 34, 36, 38, 40, 42, 44 or 46, or at least about 10 consecutive amino acids from a portion of SEQ ID NOs: 2, 25, 28, 30, 32, 34, 36, 38, 40, 42, 44 or 46. In one embodiment, the portion corresponds to about amino acid 1 to about amino acid 575 of SEQ ID NO: 2, about amino acid 18 to about amino acid 575 of SEQ ID NO: 2, from about amino acid 1 to about amino acid 576 set forth in SEQ ID NO: 25, or from about amino acid 1 to about amino acid 576 set forth in SEQ ID NO: 25. Coding nucleic acid molecules of the invention preferably comprise at least about 200, 250, 300, 350, 400, 410, 420, 430, 435 or 440 base pairs.

The invention further pertains to nucleic acid molecules for use as probes/primer or antisense molecules (i.e. non-coding nucleic acid molecules), which can comprise at least about 6, 12, 20, 30, 50, 100, 125, 150 or 200 nucleotides or base pairs. Yet other preferred nucleic acids of the invention comprise at least about 300, at least about 350, at least about 400, at least about 450, at least about 500, or at least about 600 nucleotides of SEQ ID NOs: 1, 3, 24, 26, 27, 29, 31, 33, 35, 37, 39, 41, 43 or 45. In some embodiments, the nucleic acids of the invention correspond to a 5' portion of nucleic acid sequence SEQ ID NO: 1, 3, 24, 26, 27, 29, 31, 33, 35, 37, 39, 41, 43 or 45. For example, a nucleic acid of the invention can correspond to a portion of about nucleotide 1 to about nucleotide 2000 of nucleic acid sequence SEQ ID NO: 1, 3, 24, 26, 27, 29, 31, 33, 35, 37, 39, 41, 43 or 45.

Preferred nucleic acids for use as a probe according to the methods of the invention include nucleic acids comprising a nucleotide sequence having at least about 6, preferably at least about 9, more preferably at least about 12 and even more preferably at least about 15 consecutive nucleotides from SEQ ID NOs: Nos:1, 3, 24, 26, 27, 29, 31, 33, 35, 37, 39, 41, 43 or 45, or from a portion thereof. In a preferred embodiment, the portion corresponds to about nucleotide 1 to about nucleotide 2060 of SEQ ID NOs:Nos:1, 3, 24, 26, 27, 29, 31, 33, 35, 37, 39, 41, 43 or 45. Alternatively a portion can be a nucleotide sequence encoding a conserved motif of hDelta3 or mDelta3 protein. Alternatively, the portion can be a nucleotide sequence located between nucleic acid sequences encoding conserved motifs of a human or mouse Delta3 protein.

The invention further provides for a combination of at least two nucleic acids corresponding to at least a portion of SEQ ID NOs: Nos:1, 3, 24, 26, 27, 29, 31, 33, 35, 37, 39, 41, 43 or 45, or a homolog thereof. Accordingly, in one embodiment, the invention provides a combination of two nucleic acids of at least about 6, preferably at least about 9, more preferably at least about 12 and even more preferably at least about 15 consecutive nucleotides from SEQ ID NOs: Nos:1, 3, 24, 26, 27, 29, 31, 33, 35, 37, 39, 41, 43 or 45, or from a portion thereof. In a preferred embodiment, at least one of the nucleic acids is labeled.

Another aspect of the invention provides a nucleic acid which hybridizes under stringent conditions to a nucleic acid represented by one of SEQ ID Nos:1, 3, 24, 26, 27, 29, 31, 33, 35, 37, 39, 41, 43 or 45. In yet another embodiment, a naturally occurring Delta3 nucleic acid of the invention, e.g., SEQ ID NO: 1, 3, 24 or 26 hybridizes under high stringency conditions to a species variant of Delta3, such as a species variant shown in any one of SEQ ID NOs: 27, 29, 31, 33, 35, 37, 39, 41, 43 or 45. In yet another embodiment, a Delta3 nucleic acid, e.g., SEQ ID NO: 1, 3, 24, 26, 27, 29, 31, 33, 35, 37, 39, 41, 43 or 45 hybridizes under high stringency conditions to a representative mammalian Delta3.

Preferred nucleic acids have a sequence at least about 75% identical and more preferably at least about 80% and even more preferably at least about 85% identical with a nucleic acid sequence of a Delta3 gene, such as a human Delta3 gene or a mouse Delta3 gene, e.g., such as a sequence shown in one of SEQ ID NOs: 1, 3, 24, 26, 27, 29, 31, 33, 35, 37, 39, 41, 43 or 45. Nucleic acids at least about 90%, more preferably at least about 95%, and most preferably at least about 98-99% homologous with a nucleic sequence represented in one of SEQ ID NOs: 1, 3, 24, 26, 27, 29, 31, 33, 35, 37, 39, 41, 43 or 45 are of course also within the scope of the invention. In preferred embodiments, the nucleic acid is a human Delta3 gene and in particularly preferred embodiments, includes all or a portion of the nucleotide sequence corresponding to the coding region of one of SEQ ID NOs: 1, 3, 24, 26, 27, 29, 31, 33, 35, 37, 39, 41, 43 or 45.

In addition to naturally-occurring allelic variants of the FTHMA-070, T85, Tango77, T129 or A259 sequence that may exist in the population, the skilled artisan will further appreciate that changes can be introduced by mutation into the nucleotide sequence of SEQ ID NO:53, SEQ ID NO:55, SEQ ID NO:57, SEQ ID NO:58, SEQ ID NO:71, SEQ ID NO:73, SEQ ID NO:76, SEQ ID NO:80, 137, 139, 145, 146, 163, 164 or the cDNA of ATCC 98807, thereby leading to changes in the amino acid sequence of the encoded FTHMA-070, T85, Tango77, T129 or A259 protein, without altering the functional ability of the FTHMA-070, T85, Tango77, T129 or A259 protein. For example, one can make nucleotide substitutions leading to amino acid substitutions at "non-essential" amino acid residues. A "non-essential" amino acid residue is a residue that can be altered from the wild-type sequence of FTHMA-070, T85, Tango77, T129 or A259 (e.g., the sequence of SEQ ID NO:54, SEQ ID NO:72, SEQ ID NO:75, SEQ ID NO:77, SEQ ID NO:79, SEQ ID NO:81, SEQ ID NO:83, SEQ ID NO:138, SEQ ID NO:147 or SEQ ID NO:165) without altering the biological activity, whereas an "essential" amino acid residue is required for biological activity. For example, amino acid residues that are conserved among the FTHMA-070, T85, Tango77, T129 or A259 proteins of various species are predicted to be particularly unamenable to alteration.

For example, preferred T85 proteins of the present invention, contain at least one fibronectin III or Ig superfamily domain. Such conserved domains are less likely to be amenable to mutation. Other amino acid residues, however, (e.g., those that are not conserved or only semi-conserved among T85 of various species) may not be essential for activity and thus are likely to be amenable to alteration.

Accordingly, another aspect of the invention pertains to nucleic acid molecules encoding FTHMA-070, T85, Tango77, T129 or A259 proteins that contain changes in amino acid residues that are not essential for activity. Such FTHMA-070, T85, Tango77, T129 or A259 proteins differ in amino acid sequence from SEQ ID NO:54, SEQ ID NO:58, SEQ ID NO:72, SEQ ID NO:75, SEQ ID NO:77, SEQ ID NO:79, SEQ ID NO:81, SEQ ID NO:83, SEQ ID NO: 138, SEQ ID NO:147 or SEQ ID NO:165, respectively, yet retain biological activity.

For example, preferred T129 proteins of the present invention, contain at least one TNFR/NGFR cysteine rich domain. Such conserved domains are less likely to be amenable to mutation. Other amino acid residues, however, (e.g., those that are not conserved or only semi-conserved among T129 of various species) may not be essential for activity and thus are likely to be amenable to alteration.

In one embodiment, the isolated nucleic acid molecule includes a nucleotide sequence encoding a protein that includes an amino acid sequence that is at least about 45% identical, 65%, 75%, 85%, 95%, or 98% identical to the amino acid sequence of SEQ ID NO:72, SEQ ID NO:75, SEQ ID NO:77, SEQ ID NO:79, SEQ ID NO:81, SEQ ID NO:83, SEQ ID NO:138, SEQ ID NO:147 or SEQ ID NO:165.

An isolated nucleic acid molecule encoding a FTHMA-070, T85, Tango77, T129 or A259 protein having a sequence which differs from that of SEQ ID NO:54, SEQ ID NO:58, SEQ ID NO:72, SEQ ID NO:75, SEQ ID NO:77, SEQ ID NO:79, SEQ ID NO:81, SEQ ID NO:83, SEQ ID NO:83, SEQ ID NO:138, SEQ ID NO: 147 or SEQ ID NO:165, respectively, can be created by introducing one or more nucleotide substitutions, additions or deletions into the nucleotide sequence of SEQ ID NO:53, SEQ ID NO:55, SEQ ID NO:57, SEQ ID NO:58, SEQ ID NO:71, SEQ ID NO:73, SEQ ID NO:76, SEQ ID NO:80, SEQ ID NO:137, SEQ ID NO:139, SEQ ID NO:145, SEQ ID NO:146, SEQ ID NO:163 or SEQ ID NO:164 or the cDNA of ATCC 98807 such that one or more amino acid substitutions, additions or deletions are introduced into the encoded protein. Mutations can be introduced by standard techniques, such as site-directed mutagenesis and PCR-mediated mutagenesis. Preferably, conservative amino acid substitutions are made at one or more predicted non-essential amino acid residues. A "conservative amino acid substitution" is one in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). Thus, a predicted nonessential amino acid residue in FTHMA-070, T85, Tango77, T129 or A259 is preferably replaced with another amino acid residue from the same side chain family. Alternatively, mutations can be introduced randomly along all or part of a FTHMA-070, T85, Tango77, T129 or A259 coding sequence, such as by saturation mutagenesis, and the resultant mutants can be screened for FTHMA-070, T85, Tango77, T129 or A259 biological activity to identify mutants that retain activity. Following mutagenesis, the encoded protein can be expressed recombinantly and the activity of the protein can be determined.

In a preferred embodiment, a mutant FTHMA-070 or T85 protein can be assayed for the ability to form protein:protein interactions with other proteins.

In a preferred embodiment, a mutant Tango-77 protein can be assayed for: (1) the ability to form protein:protein interactions with proteins in the Tango-77 signalling pathway; (2) the ability to bind a Tango-77 ligand or receptor; or (3) the ability to bind to an intracellular target protein or (4) the ability to interact with a protein involved in inflammation or (5) the ability to bind the IL-1 receptor. In yet another preferred embodiment, a mutant Tango-77 can be assayed for the ability to modulate inflammation, asthma, autoimmune diseases, and sepsis.

In a preferred embodiment, a mutant A259 polypeptide that is a variant of a A259 polypeptide of the invention can be assayed for: (1) the ability to form protein:protein interactions with proteins in a signaling pathway of the polypeptide of the invention; (2) the ability to bind a ligand of the polypeptide of the invention; or (3) the ability to bind to an intracellular target protein of the polypeptide of the invention. In yet another preferred embodiment, the mutant polypeptide can be assayed for the ability to modulate cellular proliferation, cellular migration or chemotaxis, or cellular differentiation.

In addition to naturally-occurring allelic variants of the SPOIL sequences that may exist in the population, the skilled artisan will further appreciate that changes can be introduced by mutation into the nucleotide sequences of SEQ ID NO:89, SEQ ID NO:101, SEQ ID NO:104, SEQ ID NO:112, the DNA insert of the plasmid deposited with ATCC as Accession Number 98883, or the DNA insert of the plasmid deposited with ATCC as Accession Number 98984, thereby leading to changes in the amino acid sequence of the encoded SPOIL proteins, without altering the functional ability of the SPOIL proteins. For example, nucleotide substitutions leading to amino acid substitutions at "non-essential" amino acid residues can be made in the sequence of SEQ ID NO:89, SEQ ID NO:101, SEQ ID NO:104, SEQ ID NO:112, the DNA insert of the plasmid deposited with ATCC as Accession Number 98883, or the DNA insert of the plasmid deposited with ATCC as Accession Number 98984. A "non-essential" amino acid residue is a residue that can be altered from the wild-type sequence of SPOIL (e.g., the sequence of SEQ ID NO:90, SEQ ID NO:102, SEQ ID NO:105, SEQ ID NO:113, the amino acid sequence encoded by the DNA insert of the plasmid deposited with ATCC as Accession Number 98883, or the amino acid sequence encoded by the DNA insert of the plasmid deposited with ATCC as Accession Number 98984) without altering the biological activity, whereas an "essential" amino acid residue is required for biological activity. For example, amino acid residues of SPOIL that are conserved among the human and murine family numbers of this invention, (as indicated by the alignment and comparison of the amino acid sequences of SEQ ID NO:90, SEQ ID NO:102, SEQ ID NO:105, SEQ ID NO:113) are predicted to be essential in SPOIL and, thus are not likely to be amenable to alteration. Table III further sets forth conserved amino residues among SPOIL proteins which are predicted to be unamenable to alteration. Furthermore, amino acid residues that are conserved among the SPOIL proteins of the present invention, and the IL-1ra protein (as indicated by the alignment presented in FIG. 4) are predicted to be unamenable to alteration.

Accordingly, another aspect of the invention pertains to nucleic acid molecules encoding SPOIL proteins that contain changes in amino acid residues that are not essential for activity. Such SPOIL proteins differ in amino acid sequence from SEQ ID NO:90, SEQ ID NO:102, SEQ ID NO: 105, SEQ ID NO:113, the amino acid sequence encoded by the DNA insert of the plasmid deposited with ATCC as Accession Number 98883, or the amino acid sequence encoded by the DNA insert of the plasmid deposited with ATCC as Accession Number 98984, yet retain biological activity. In one embodiment, the isolated nucleic acid molecule comprises a nucleotide sequence encoding a protein, wherein the protein comprises an amino acid sequence at least about 60% identical to the amino acid sequence of SEQ ID NO:90, SEQ ID NO:102, SEQ ID NO:105, SEQ ID NO:113, the amino acid sequence encoded by the DNA insert of the plasmid deposited with ATCC as Accession Number 98883, or the amino acid sequence encoded by the DNA insert of the plasmid deposited with ATCC as Accession Number 98984. Preferably, the protein encoded by the nucleic acid molecule is at least about 65-70% identical to SEQ ID NO:90, SEQ ID NO:102, SEQ ID NO:105, SEQ ID NO:113, the amino acid sequence encoded by the DNA insert of the plasmid deposited with ATCC as Accession Number 98883, or the amino acid sequence encoded by the DNA insert of the plasmid deposited with ATCC as Accession Number 98984, more preferably at least about 75-80% identical to SEQ ID NO:90, SEQ ID NO:102, SEQ ID NO:105, SEQ ID NO:113, the amino acid sequence encoded by the DNA insert of the plasmid deposited with ATCC as Accession Number 98883, or the amino acid sequence encoded by the DNA insert of the plasmid deposited with ATCC as Accession Number 98984, even more preferably at least about 85-90% identical to SEQ ID NO:90, SEQ ID NO:102, SEQ ID NO:105, SEQ ID NO:113, the amino acid sequence encoded by the DNA insert of the plasmid deposited with ATCC as Accession Number 98883, or the amino acid sequence encoded by the DNA insert of the plasmid deposited with ATCC as Accession Number 98984, and most preferably at least about 95% identical to SEQ ID NO:90, SEQ ID NO:102, SEQ ID NO:105, SEQ ID NO:113, the amino acid sequence encoded by the DNA insert of the plasmid deposited with ATCC as Accession Number 98883, or the amino acid sequence encoded by the DNA insert of the plasmid deposited with ATCC as Accession Number 98984.

An isolated nucleic acid molecule encoding a SPOIL protein homologous to the protein of SEQ ID NO:90, SEQ ID NO:102, SEQ ID NO:105, SEQ ID NO:113, the amino acid sequence encoded by the DNA insert of the plasmid deposited with ATCC as Accession Number 98883, or the amino acid sequence encoded by the DNA insert of the plasmid deposited with ATCC as Accession Number 98984, can be created by introducing one or more nucleotide substitutions, additions or deletions into the nucleotide sequence of SEQ ID NO:90, SEQ ID NO:102, SEQ ID NO:105, SEQ ID NO:113, the DNA insert of the plasmid deposited with ATCC as Accession Number 98883, or the DNA insert of the plasmid deposited with ATCC as Accession Number 98984, such that one or more amino acid substitutions, additions or deletions are introduced into the encoded protein. Mutations can be introduced into SEQ ID NO:89, SEQ ID NO:101, SEQ ID NO:104, SEQ ID NO: 112, the DNA insert of the plasmid deposited with ATCC as Accession Number 98883, or the DNA insert of the plasmid deposited with ATCC as Accession Number 98984, by standard techniques, such as site-directed mutagenesis and PCR-mediated mutagenesis.

Alternatively, in another embodiment, mutations can be introduced randomly along all or part of a SPOIL coding sequence, such as by saturation mutagenesis, and the resultant mutants can be screened for SPOIL biological activity to identify mutants that retain activity. Following mutagenesis of SEQ ID NO:89, SEQ ID NO:101, SEQ ID NO:104, SEQ ID NO:112, the DNA insert of the plasmid deposited with ATCC as Accession Number 98883, or the DNA insert of the plasmid deposited with ATCC as Accession Number 98984, the encoded protein can be expressed recombinantly and the activity of the protein can be determined.

In a preferred embodiment, a mutant SPOIL-I protein can be assayed for (1) the ability to modulate IL-1 signal transduction, either in vitro or in vivo; (2) modulate IL-1 stimulated cell development or differentiation, either in vitro or in vivo; and (3) modulate IL-1 stimulated cellular proliferation, either in vitro or in vivo. In yet another preferred embodiment, a mutant SPOIL can be assayed for ability to 1) modulate cellular signal transduction; 2) regulate cellular proliferation; 3) regulate cellular differentiation; 4) modulate a cell involved in immune response; and 5) modulate a cell involved in bone metabolism (e.g. osteoblast or osteoclasts).

Moreover, nucleic acid molecules encoding other NEOKINE family members (e.g., NEOKINE-2), and thus which have a nucleotide sequence which differs from the NEOKINE-1 sequences of SEQ ID NO:115, SEQ ID NO:118, SEQ ID NO:121, SEQ ID NO:124, or the nucleotide sequence of the DNA insert of the plasmid deposited with ATCC as Accession Number 98751 are intended to be within the scope of the invention. For example, a NEOKINE-2 cDNA can be identified based on the nucleotide sequence of human NEOKINE-1. Moreover, nucleic acid molecules encoding NEOKINE proteins from different species, and thus which have a nucleotide sequence which differs from the NEOKINE sequences of SEQ ID NO:115, SEQ ID NO:118, SEQ ID NO:121, SEQ ID NO:124, or the nucleotide sequence of the DNA insert of the plasmid deposited with ATCC as Accession Number 98751 are intended to be within the scope of the invention. For example, a Xenopus NEOKINE cDNA can be identified based on the nucleotide sequence of a human NEOKINE.

Nucleic acid molecules corresponding to natural allelic variants and homologues of the NEOKINE cDNAs of the invention can be isolated based on their homology to the NEOKINE nucleic acids disclosed herein using the cDNAs disclosed herein, or a portion thereof, as a hybridization probe according to standard hybridization techniques under stringent hybridization conditions.

Accordingly, in another embodiment, an isolated nucleic acid molecule of the invention is at least 15 nucleotides in length and hybridizes under stringent conditions to the nucleic acid molecule comprising the nucleotide sequence of SEQ ID NO:115, SEQ ID NO:118, SEQ ID NO:121, SEQ ID NO:124, or the nucleotide sequence of the DNA insert of the plasmid deposited with ATCC as Accession Number 98751. In other embodiment, the nucleic acid is at least 30, 50, 100, 250 or 500 nucleotides in length. As used herein, the term "hybridizes under stringent conditions" is intended to describe conditions for hybridization and washing under which nucleotide sequences at least 60% homologous to each other typically remain hybridized to each other. Preferably, the conditions are such that sequences at least about 70%, more preferably at least about 80%, even more preferably at least about 85% or 90% homologous to each other typically remain hybridized to each other. Such stringent conditions are known to those skilled in the art and can be found in *Current Protocols in Molecular Biology*, John Wiley & Sons, N.Y. (1989), 6.3.1-6.3.6. A preferred, non-limiting example of stringent hybridization conditions are hybridization in 6× sodium chloride/sodium citrate (SSC) at about 45° C., followed by one or more washes in 0.2×SSC, 0.1% SDS at 50° C., preferably 55° C., and more preferably 60° C. or 65° C. Preferably, an isolated nucleic acid molecule of the invention that hybridizes under stringent conditions to the sequence of SEQ ID NO:115, SEQ ID NO:118, SEQ ID NO:121, SEQ ID NO:124, corresponds to a naturally-occurring nucleic acid molecule. As used herein, a "naturally-occurring" nucleic acid molecule refers to an RNA or DNA molecule having a nucleotide sequence that occurs in nature (e.g., encodes a natural protein).

In addition to naturally-occurring allelic variants of the NEOKINE sequences that may exist in the population, the skilled artisan will further appreciate that changes can be introduced by mutation into the nucleotide sequences of SEQ ID NO:115, SEQ ID NO: 118, SEQ ID NO:121, SEQ ID NO:124, or the nucleotide sequence of the DNA insert of the plasmid deposited with ATCC as Accession Number 98751, thereby leading to changes in the amino acid sequence of the encoded NEOKINE proteins, without altering the functional ability of the NEOKINE proteins. For example, nucleotide substitutions leading to amino acid substitutions at "non-essential" amino acid residues can be made in the sequence of SEQ ID NO:115, SEQ ID NO:118, SEQ ID NO:121, SEQ ID NO:124, or the nucleotide sequence of the DNA insert of the plasmid deposited with ATCC as Accession Number 98751. A "non-essential" amino acid residue is a residue that can be altered from the wild-type sequence of NEOKINE (e.g., the sequence of SEQ ID NO:116, SEQ ID NO:119, SEQ ID NO:122, or SEQ ID NO:125) without altering the biological activity, whereas an "essential" amino acid residue is required for biological activity. For example, amino acid residues that are conserved among the NEOKINE proteins of the present invention, are predicted to be particularly unamenable to alteration (e.g., the four conserved cycteines). Moreover, amino acid residues that are defined by the NEOKINE CXC motif are particularly unamenable to alteration. Furthermore, additional amino acid residues that are conserved between the NEOKINE proteins of the present invention as depicted in FIG. 5 are not likely to be amenable to alteration.

Accordingly, another aspect of the invention pertains to nucleic acid molecules encoding NEOKINE proteins that contain changes in amino acid residues that are not essential for activity. Such NEOKINE proteins differ in amino acid sequence from SEQ ID NO:116, SEQ ID NO:119, SEQ ID NO:122, or SEQ ID NO:125 yet retain biological activity. In one embodiment, the isolated nucleic acid molecule comprises a nucleotide sequence encoding a protein, wherein the protein comprises an amino acid sequence at least about 60% homologous to the amino acid sequence of SEQ ID NO:116, SEQ ID NO:119, SEQ ID NO:122, or SEQ ID NO:125. Preferably, the protein encoded by the nucleic acid molecule is at least about 65-70% homologous to SEQ ID NO:116, SEQ ID NO:119, SEQ ID NO:122, or SEQ ID NO:125, more preferably at least about 75-80% homologous to SEQ ID NO:116, SEQ ID NO:119, SEQ ID NO:122, or SEQ ID NO:125, even more preferably at least about 85-90% homologous to SEQ ID NO:116, SEQ ID NO:119, SEQ ID NO:122, or SEQ ID NO:125, and most preferably at least about 95% homologous to SEQ ID NO:116, SEQ ID NO:119, SEQ ID NO:122, or SEQ ID NO:125.

An isolated nucleic acid molecule encoding a NEOKINE protein homologous to the protein of SEQ ID NO:116, SEQ ID NO:119, SEQ ID NO:122, or SEQ ID NO:125 can be created by introducing one or more nucleotide substitutions, additions or deletions into the nucleotide sequence of SEQ ID NO:115, SEQ ID NO:118, SEQ ID NO:121, SEQ ID NO:124, or the nucleotide sequence of the DNA insert of the plasmid deposited with ATCC as Accession Number 98751, such that one or more amino acid substitutions, additions or deletions are introduced into the encoded protein. Mutations can be introduced into SEQ ID NO:115, SEQ ID NO:118, SEQ ID NO:121, SEQ ID NO:124, or the nucleotide sequence of the DNA insert of the plasmid deposited with ATCC as Accession Number 98751 by standard techniques, such as site-directed mutagenesis and PCR-mediated mutagenesis. Thus, a predicted nonessential amino acid residue in a NEOKINE protein is preferably replaced with another amino acid residue from the same side chain family. Alternatively, in another embodiment, mutations can be introduced randomly along all or part of a NEOKINE coding sequence, such as by saturation mutagenesis, and the resultant mutants can be screened for NEOKINE biological activity to identify mutants that retain activity. Following mutagenesis of SEQ ID NO:115, SEQ ID NO:118, SEQ ID NO:121, SEQ ID NO:124, or the nucleotide sequence of the DNA insert of the plasmid deposited with ATCC as Accession Number 98751, the encoded protein can be expressed recombinantly and the activity of the protein can be determined.

In a preferred embodiment, a mutant NEOKINE protein can be assayed for (1) modulation of cellular signal transduction, either in vitro or in vivo; (2) regulation of gene transcription in a cell expressing a NEOKINE receptor (e.g., RDC1) or receptor which is specific for another chemokine; (3) regulation of gene transcription in a cell expressing a NEOKINE receptor or receptor which is specific for another chemokine, wherein said cell is involved in angiogenesis or inflammation; (4) regulation of angiogenesis; (5) regulation of angiogenesis, wherein said regulation comprises inhibition of angiogenesis; (6) regulation of angiogenesis, wherein said regulation comprises maintenance of angiostasis; (7) regulation of inflammation; and (8) regulation of inflammation, wherein said regulation comprises inhibition of chemoattraction (e.g., neutrophil chemoattraction).

The present invention encompasses antisense nucleic acid molecules, i.e., molecules which are complementary to a sense nucleic acid encoding a polypeptide of the invention, e.g., complementary to the coding strand of a double-stranded cDNA molecule or complementary to an mRNA sequence. Accordingly, an antisense nucleic acid can hydrogen bond to a sense nucleic acid. The antisense nucleic acid can be complementary to an entire Delta3, FTHMA-070, Tango85, Tango77, SPOIL, NEOKINE, Tango129 or A259 coding strand, or to only a portion thereof, e.g., all or part of the protein coding region (or open reading frame). An antisense nucleic acid molecule can be antisense to all or part of a Delta3, FTHMA-070, Tango85, Tango77, SPOIL, NEOKINE, Tango129 or A259 non-coding region of the coding strand of a nucleotide sequence encoding a Delta3, FTHMA-070, Tango85, Tango77, SPOIL, NEOKINE, Tango129 or A259 polypeptide of the invention. The non-coding regions ("5' and 3' untranslated regions") are the 5' and 3' sequences which flank the coding region and are not translated into amino acids.

Given the coding strand sequences encoding FTHMA-070 or T85 disclosed herein, antisense nucleic acids of the invention can be designed according to the rules of Watson and Crick base pairing. The antisense nucleic acid molecule can be complementary to the entire coding region of FTHMA-070 or T85 mRNA, but more preferably is an oligonucleotide which is antisense to only a portion of the coding or noncoding region of FTHMA-070 or T85 mRNA.

Given the coding strand sequences encoding Tango-77 disclosed herein (e.g., SEQ ID NO:73, SEQ ID NO:75, or SEQ ID NO:78), antisense nucleic acids of the invention can be designed according to the rules of Watson and Crick base pairing. The antisense nucleic acid molecule can be complementary to the entire coding region of Tango-77 mRNA, but more preferably is an oligonucleotide which is antisense to only a portion of the coding or noncoding region of Tango-77 mRNA. For example, the antisense oligonucleotide can be complementary to the region surrounding the translation start site of Tango-77 mRNA, e.g., an oligonucleotide having the sequence

```
5'-TGCAACTTTTACAGGAAACAC-3'     (SEQ ID NO: 193)
or

5'-CCTCACTTTTACCCGAGACTC-3'     (SEQ ID NO: 194)
or

5'-GACGGGTGGTACTTAAAACAA-3'.    (SEQ ID NO: 195)
```

Given the coding strand sequences encoding SPOIL disclosed herein (e.g., SEQ ID NO:89, SEQ ID NO:101, SEQ ID NO:104, SEQ ID NO:112, the DNA insert of the plasmid deposited with ATCC as Accession Number 98883, or the DNA insert of the plasmid deposited with ATCC as Accession Number 98984), antisense nucleic acids of the invention can be designed according to the rules of Watson and Crick base pairing. The antisense nucleic acid molecule can be complementary to the entire coding region of SPOIL mRNA, but more preferably is an oligonucleotide which is antisense to only a portion of the coding region of SPOIL mRNA. For example, the antisense oligonucleotide can be complementary to the region surrounding the translation start site of SPOIL mRNA.

Given the coding strand sequences encoding NEOKINE disclosed herein (e.g., SEQ ID NO: 117, SEQ ID NO:120, or SEQ ID NO:123), antisense nucleic acids of the invention can be designed according to the rules of Watson and Crick base pairing. The antisense nucleic acid molecule can be complementary to the entire coding region of NEOKINE mRNA, but more preferably is an oligonucleotide which is antisense to only a portion of the coding or noncoding region of NEOKINE mRNA. For example, the antisense oligonucleotide can be complementary to the region surrounding the translation start site of NEOKINE mRNA.

Given the coding strand sequences encoding T129 disclosed herein (e.g., SEQ ID NO:137 or SEQ ID NO:139), antisense nucleic acids of the invention can be designed according to the rules of Watson and Crick base pairing. The antisense nucleic acid molecule can be complementary to the entire coding region of T129 mRNA, but more preferably is an oligonucleotide which is antisense to only a portion of the coding or noncoding region of T129 mRNA. For example, the antisense oligonucleotide can be complementary to the region surrounding the translation start site of T129 mRNA, e.g., an oligonucleotide having the sequence

```
CTGGTGGTCCCCGGACTCCTACTTCGGTT    (SEQ ID NO: 143)
or

GACTCCTACTTCGGTTCAGA.            (SEQ ID NO: 144)
```

An antisense oligonucleotide can be, for example, about 5, 10, 15, 20, 25, 30, 35, 40, 45 or 50 nucleotides in length. An antisense nucleic acid of the invention can be constructed using chemical synthesis and enzymatic ligation reactions using procedures known in the art. For example, an antisense nucleic acid (e.g., an antisense oligonucleotide) can be chemically synthesized using naturally-occurring nucleotides or variously modified nucleotides designed to increase the biological stability of the molecules or to increase the physical stability of the duplex formed between the antisense and sense nucleic acids, e.g., phosphorothioate derivatives and acridine substituted nucleotides can be used. Examples of modified nucleotides which can be used to generate the antisense nucleic acid include 5-fluorouracil, 5-bromouracil, 5-chlorouracil, 5-iodouracil, hypoxanthine, xanthine, 4-acetylcytosine, 5-(carboxyhydroxylmethyl) uracil, 5-carboxymethylaminomethyl-2-thiouridine, 5-carboxymethylaminomethyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-N-6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid (v), 5-methyl-2-thiouracil, 3-(3-amino-3-N2-carboxypropyl) uracil, (acp3)w, and 2,6-diaminopurine. Alternatively, the antisense nucleic acid can be produced biologically using an expression vector into which a nucleic acid has been subcloned in an antisense orientation (i.e., RNA transcribed from the inserted nucleic acid will be of an antisense orientation to a target nucleic acid of interest, described further in the following subsection).

The antisense nucleic acid molecules of the invention are typically administered, individually or in combination (that is two, three, four, or more different antisense molecules), to a subject or generated in situ such that they hybridize with or bind to cellular mRNA and/or genomic DNA encoding a selected polypeptide of the invention to thereby inhibit expression, e.g., by inhibiting transcription and/or translation. The hybridization can be by conventional nucleotide complementarity to form a stable duplex, or, for example, in the case of an antisense nucleic acid molecule which binds to DNA duplexes, through specific interactions in the major groove of the double helix. An example of a route of administration of antisense nucleic acid molecules of the invention includes direct injection at a tissue site. Alternatively, antisense nucleic acid molecules can be modified to target selected cells and then administered systemically. For example, for systemic administration, antisense molecules can be modified such that they specifically bind to receptors or antigens expressed on a selected cell surface, e.g., by linking the antisense nucleic acid molecules to peptides or antibodies which bind to cell surface receptors or antigens. The antisense nucleic acid molecules can also be delivered to cells using the vectors described herein. To achieve sufficient intracellular concentrations of the antisense molecules, vector constructs in which the antisense nucleic acid molecule is placed under the control of a strong pol II or pol III promoter are preferred.

An antisense nucleic acid molecule of the invention can be an α-anomeric nucleic acid molecule. An α-anomeric nucleic acid molecule forms specific double-stranded hybrids with complementary RNA in which, contrary to the usual β-units, the strands run parallel to each other (Gaultier et al. (1987) *Nucleic Acids Res.* 15:6625-6641). The antisense nucleic acid molecule can also comprise a 2'-o-methylribonucleotide (Inoue et al. (1987) *Nucleic Acids Res.* 15:6131-6148) or a chimeric RNA-DNA analogue (Inoue et al. (1987) *FEBS Lett.* 215:327-330).

The invention also encompasses ribozymes. Ribozymes are catalytic RNA molecules with ribonuclease activity which are capable of cleaving a single-stranded nucleic acid, such as an mRNA, to which they have a complementary region. Thus, ribozymes (e.g., hammerhead ribozymes (described in Haselhoff and Gerlach (1988) *Nature* 334:585-591)) can be used to catalytically cleave mRNA transcripts to thereby inhibit translation of the protein encoded by the mRNA. A ribozyme having specificity for a nucleic acid molecule encoding a polypeptide of the invention can be designed based upon the nucleotide sequence of a cDNA disclosed herein. For example, a derivative of a Tetrahymena L-19 IVS RNA can be constructed in which the nucleotide sequence of the active site is complementary to the nucleotide sequence to be cleaved in a Cech et al. U.S. Pat. No. 4,987,071; and Cech et al. U.S. Pat. No. 5,116,742. Alternatively, an mRNA encoding a polypeptide of the invention can be used to select a catalytic RNA having a specific ribonuclease activity from a pool of RNA molecules. See, e.g., Bartel and Szostak (1993) *Science* 261:1411-1418.

The invention also encompasses nucleic acid molecules which form triple helical structures. For example, expression of a polypeptide of the invention can be inhibited by targeting nucleotide sequences complementary to the regulatory region of the gene encoding the polypeptide (e.g., the promoter and/or enhancer) to form triple helical structures that prevent transcription of the gene in target cells. See generally Helene (1991) *Anticancer Drug Des.* 6(6):569-84; Helene (1992) *Ann. N.Y. Acad. Sci.* 660:27-36; and Maher (1992) *Bioassays* 14(12):807-15.

In various embodiments, the nucleic acid molecules of the invention can be modified at the base moiety, sugar moiety or phosphate backbone to improve, e.g., the stability, hybridization, or solubility of the molecule. For example, the deoxyribose phosphate backbone of the nucleic acids can be modified to generate peptide nucleic acids (see Hyrup et al. (1996) *Bioorganic & Medicinal Chemistry* 4(1): 5-23). As used herein, the terms "peptide nucleic acids" or "PNAs" refer to nucleic acid mimics, e.g., DNA mimics, in which the deoxyribose phosphate backbone is replaced by a pseudopeptide backbone and only the four natural nucleobases are retained. The neutral backbone of PNAs has been shown to allow for specific hybridization to DNA and RNA under conditions of low ionic strength. The synthesis of PNA oligomers can be performed using standard solid phase peptide synthesis protocols as described in Hyrup et al. (1996) *Bioorganic & Medicinal Chemistry* 4(1): 5-23; Perry-O'Keefe et al. (1996) *Proc. Natl. Acad. Sci. USA* 93: 14670-675.

PNAs of Delta3, FTHMA-070, Tango85, Tango77, SPOIL, NEOKINE, Tango129 and A259 can be used in therapeutic and diagnostic applications. For example, PNAs can be used as antisense or antigene agents for sequence-specific modulation of gene expression by, e.g., inducing transcription or translation arrest or inhibiting replication. PNAs can also be used, e.g., in the analysis of single base pair mutations in a gene by, e.g., PNA directed PCR clamping; as artificial restriction enzymes when used in combination with other enzymes, e.g., S1 nucleases (Hyrup et al. (1996) *Bioorganic & Medicinal Chemistry* 4(1): 5-23; or as probes or primers for DNA sequence and hybridization (Hyrup et al. (1996) *Bioorganic & Medicinal Chemistry* 4(1): 5-23; Perry-O'Keefe et al. (1996) *Proc. Natl. Acad. Sci. USA* 93: 14670-675).

In another embodiment, PNAs of Delta3, FTHMA-070, Tango85, Tango77, SPOIL, NEOKINE, Tango129 and A259 can be modified, e.g., to enhance their stability or cellular uptake, by attaching lipophilic or other helper groups to PNA, by the formation of PNA-DNA chimeras, or by the use of liposomes or other techniques of drug delivery known in the art. For example, PNA-DNA chimeras can be generated which may combine the advantageous properties of PNA and DNA. Such chimeras allow DNA recognition enzymes, e.g., RNAse H and DNA polymerases, to interact with the DNA portion while the PNA portion would provide high binding affinity and specificity. PNA-DNA chimeras can be linked using linkers of appropriate lengths selected in terms of base stacking, number of bonds between the nucleobases, and orientation (Hyrup et al. (1996) *Bioorganic & Medicinal Chemistry* 4(1): 5-23). The synthesis of PNA-DNA chimeras can be performed as described in Hyrup et al. (1996) *Bioorganic & Medicinal Chemistry* 4(1): 5-23, and Finn et al. (1996) *Nucleic Acids Res.* 24(17):3357-63. For example, a DNA chain can be synthesized on a solid support using standard phosphoramidite coupling chemistry and modified nucleoside analogs. Compounds such as 5'-(4-methoxytrityl) amino-5'-deoxy-thymidine phosphoramidite can be used as a link between the PNA and the 5' end of DNA (Mag et al. (1989) *Nucleic Acids Res.* 17:5973-88). PNA monomers are then coupled in a stepwise manner to produce a chimeric molecule with a 5' PNA segment and a 3' DNA segment (Finn et al. (1996) *Nucleic Acids Res.* 24(17):3357-63). Alternatively, chimeric molecules can be synthesized with a 5' DNA segment and a 3' PNA segment (Peterser et al. (1975) *Bioorganic Med. Chem. Lett.* 5:1119-11124).

In other embodiments, the oligonucleotide may include other appended groups such as peptides (e.g., for targeting host cell receptors in vivo), or agents facilitating transport across the cell membrane (see, e.g., Letsinger et al. (1989) *Proc. Natl. Acad. Sci. USA* 86:6553-6556; Lemaitre et al. (1987) *Proc. Natl. Acad. Sci. USA* 84:648-652; PCT Publication NO: WO 88/09810) or the blood-brain barrier (see, e.g., PCT Publication NO: WO 89/10134). In addition, oligonucleotides can be modified with hybridization-triggered cleavage agents (see, e.g., Krol et al. (1988) *Bio/Techniques* 6:958-976) or intercalating agents (see, e.g., Zon (1988)

*Pharm. Res.* 5:539-549). To this end, the oligonucleotide may be conjugated to another molecule, e.g., a peptide, hybridization triggered cross-linking agent, transport agent, hybridization-triggered cleavage agent, etc.

Nucleic acids having a sequence that differs from the nucleotide sequences shown in one of SEQ ID Nos: 1, 3, 24, 26, 27, 29, 31, 33, 35, 37, 39, 41, 43 or 45 due to degeneracy in the genetic code are also within the scope of the invention. Such nucleic acids encode functionally equivalent peptides (i.e., a peptide having a biological activity of a Delta3 polypeptide) but differ from the sequence shown in the sequence listing due to degeneracy in the genetic code. For example, a number of amino acids are designated by more than one triplet. Codons that specify the same amino acid, or synonyms (for example, CAU and CAC each encode histidine) may result in "silent" mutations which do not affect the amino acid sequence of a Delta3 polypeptide. However, it is expected that DNA sequence polymorphisms that do lead to changes in the amino acid sequences of the subject Delta3 polypeptides will exist. One skilled in the art will appreciate that these variations in one or more nucleotides (e.g., up to about 3-5% of the nucleotides) of the nucleic acids encoding polypeptides having an activity of a Delta3 polypeptide may exist among individuals of a given species due to natural allelic variation.

As indicated by the examples set out below, Delta3 protein-encoding nucleic acids can be obtained from mRNA present in any of a number of eukaryotic cells. It should also be possible to obtain nucleic acids encoding Delta3 polypeptides of the present invention from genomic DNA from both adults and embryos. For example, a gene encoding a Delta3 protein can be cloned from either a cDNA or a genomic library in accordance with protocols described herein, as well as those generally known to persons skilled in the art. Examples of tissues and/or libraries suitable for isolation of the subject nucleic acids include endothelial cell libraries, among others. A cDNA encoding a Delta3 protein can be obtained by isolating total mRNA from a cell, e.g., a vertebrate cell, a mammalian cell, or a human cell, including embryonic cells. Double stranded cDNAs can then be prepared from the total mRNA, and subsequently inserted into a suitable plasmid or bacteriophage vector using any one of a number of known techniques. The gene encoding a Delta3 protein can also be cloned using established polymerase chain reaction techniques in accordance with the nucleotide sequence information provided by the invention. The nucleic acid of the invention can be DNA or RNA. A preferred nucleic acid is a cDNA represented by a sequence selected from the group consisting of SEQ ID NOs: 1, 3, 24, 26, 27, 29, 31, 33, 35, 37, 39, 41, 43 or 45.

Delta3 Vectors

This invention also provides expression vectors containing a nucleic acid encoding a Delta3 polypeptide, operably linked to at least one transcriptional regulatory sequence. "Operably linked" is intended to mean that the nucleotide sequence is linked to a regulatory sequence in a manner which allows expression of the nucleotide sequence. Regulatory sequences are art-recognized and are selected to direct expression of the subject Delta3 proteins. Accordingly, the term "transcriptional regulatory sequence" includes promoters, enhancers and other expression control elements. Such regulatory sequences are described in Goeddel; *Gene Expression Technology: Methods in Enzymology* 185, Academic Press, San Diego, Calif. (1990). In one embodiment, the expression vector includes a recombinant gene encoding a peptide having an agonistic activity of a subject Delta3 polypeptide, or alternatively, encoding a peptide which is an antagonistic form of the Delta3 protein. Such expression vectors can be used to transfect cells and thereby produce polypeptides, including fusion proteins, encoded by nucleic acids as described herein. Moreover, the gene constructs of the present invention can also be used as a part of a gene therapy protocol to deliver nucleic acids encoding either an agonistic or antagonistic form of one of the subject Delta3 proteins. Thus, another aspect of the invention features expression vectors for in vivo or in vitro transfection and expression of a Delta3 polypeptide in particular cell types so as to reconstitute the function of, or alternatively, abrogate the function of Delta-induced signaling in a tissue. This could be desirable, for example, when the naturally-occurring form of the protein is expressed inappropriately; or to deliver a form of the protein which alters differentiation of tissue. Expression vectors may also be employed to inhibit neoplastic transformation.

In addition to viral transfer methods, such as those illustrated above, non-viral methods can also be employed to cause expression of a subject Delta3 polypeptide in the tissue of an animal. Most nonviral methods of gene transfer rely on normal mechanisms used by mammalian cells for the uptake and intracellular transport of macromolecules. In preferred embodiments, non-viral targeting means of the present invention rely on endocytic pathways for the uptake of the subject Delta3 polypeptide gene by the targeted cell. Exemplary targeting means of this type include liposomal derived systems, polylysine conjugates, and artificial viral envelopes.

Delta3 Probes and Primers

Moreover, the nucleotide sequences determined from the cloning of hDelta3 genes will further allow for the generation of probes and primers designed for use in identifying and/or cloning Delta3 homologs in other cell types, e.g., from other tissues, as well as Delta3 homologs from other mammalian organisms. Probes and primers of the invention can also be used to determine the identity of a Delta3 allele and/or the presence or absence of one or more mutations in a Delta3 gene of a subject. In a preferred embodiment, a probe or primer of the invention can be used to determine whether a subject has or is at risk of developing a disease or condition associated with a specific Delta3 allele, such as an allele carrying a mutation.

In a preferred embodiment, the present invention also provides a probe/primer comprising a substantially purified oligonucleotide, which oligonucleotide comprises a region of nucleotide sequence that hybridizes under stringent conditions to at least about 12, preferably about 25, more preferably about 40, 50 or 75 consecutive nucleotides of sense or antisense sequence selected from the group consisting of SEQ ID NO:1, 3, 24, 26, 27, 29, 31, 33, 35, 37, 39, 41, 43 or 45, or naturally-occurring mutants thereof. For instance, primers based on the nucleic acid represented in SEQ ID NOs:1, 3, 24, 26, 27, 29, 31, 33, 35, 37, 39, 41, 43 or 45 can be used in PCR reactions to clone Delta3 homologs, e.g., specific Delta3 alleles. Such primers are preferably selected in a region which does not share significant homology to other genes, e.g., other Delta genes. Examples of primers of the invention are set forth as SEQ ID NOs:12-15, set forth below:

```
5' end primers:
5' AGCGCCTCTGGCTGGGCGCT 3'
(SEQ ID NO: 12; corresponding to nucleotides
356 to 375 of SEQ ID NO: 1);

5' CGGCCAGAGGCCTTGCCACC 3'
(SEQ ID NO: 13; corresponding to nucleotides
725 to 744 of SEQ ID NO: 1);
```

```
3'end primers:
5' TTGCGCTCCCGGCTGGAGCC 3'
(SEQ ID NO: 14; corresponding to the complement of
nucleotides 1460 to 1479 of SEQ ID NO: 1);
and 5' ATGCGGCTTGGACCTCGGTT 3'
(SEQ ID NO: 15; corresponding to the complement of
nucleotides 1592 to 2611 of SEQ ID NO: 1).
```

Likewise, probes based on the subject Delta3 sequences can be used to detect transcripts or genomic sequences encoding the same or homologous proteins. In preferred embodiments, the probe further comprises a label group attached thereto and able to be detected, e.g., the label group is selected from amongst radioisotopes, fluorescent compounds, enzymes, and enzyme co-factors.

As discussed in more detail below, such probes can also be used as a part of a diagnostic test kit for identifying cells or tissue which misexpress a Delta3 protein, such as by measuring a level of a Delta-encoding nucleic acid in a sample of cells from a patient; e.g., detecting Delta3 mRNA levels or determining whether a genomic Delta3 gene has been mutated or deleted. Briefly, nucleotide probes can be generated from the subject Delta3 genes which facilitate histological screening of intact tissue and tissue samples for the presence (or absence) of Delta-encoding transcripts. Similar to the diagnostic uses of anti-Delta3 antibodies, the use of probes directed to Delta3 messages, or to genomic Delta3 sequences, can be used for both predictive and therapeutic evaluation of allelic mutations which might be manifest in, for example, neoplastic or hyperplastic disorders (e.g., unwanted cell growth) or abnormal differentiation of tissue. Used in conjunction with immunoassays as described herein, the oligonucleotide probes can help facilitate the determination of the molecular basis for a developmental disorder which may involve some abnormality associated with expression (or lack thereof) of a Delta3 protein. For instance, variation in polypeptide synthesis can be differentiated from a mutation in a coding sequence.

Also within the scope of the invention are kits for determining whether a subject is at risk of developing a disease or condition caused by or contributed by an aberrant Delta3 activity and/or which is associated with one or more specific Delta3 alleles. In a preferred embodiment, the kit can be used for determining whether a subject is at risk of developing a neurological disease or disorder, e.g., a peripheral neuropathy, e.g., ACCPN.

Delta3 Antisense, Ribozyme and Triplex techniques

One aspect of the invention relates to the use of the isolated nucleic acid in "antisense" therapy. As used herein, "antisense" therapy refers to administration or in situ generation of oligonucleotide molecules or their derivatives which specifically hybridize (e.g., bind) under cellular conditions, with the cellular mRNA and/or genomic DNA encoding one or more of the subject Delta3 proteins so as to inhibit expression of that protein, e.g., by inhibiting transcription and/or translation. The binding may be by conventional base pair complementarity, or, for example, in the case of binding to DNA duplexes, through specific interactions in the major groove of the double helix. In general, "antisense" therapy refers to the range of techniques generally employed in the art, and includes any therapy which relies on specific binding to oligonucleotide sequences.

An antisense construct of the present invention can be delivered, for example, as an expression plasmid which, when transcribed in the cell, produces RNA which is complementary to at least a unique portion of the cellular mRNA which encodes a Delta3 protein. Alternatively, the antisense construct is an oligonucleotide probe which is generated ex vivo and which, when introduced into the cell causes inhibition of expression by hybridizing with the mRNA and/or genomic sequences of a Delta3 gene. Such oligonucleotide probes are preferably modified oligonucleotides which are resistant to endogenous nucleases, e.g., exonucleases and/or endonucleases, and are therefore stable in vivo. Exemplary nucleic acid molecules for use as antisense oligonucleotides are phosphoramidate, phosphothioate and methylphosphonate analogs of DNA (see also U.S. Pat. Nos. 5,176,996; 5,264,564; and 5,256,775). Additionally, general approaches to constructing oligomers useful in antisense therapy have been reviewed, for example, by Van der Krol et al. (1988) *Biotechniques* 6:958-976; and Stein et al. (1988) *Cancer Res* 48:2659-2668.

With respect to antisense DNA, oligodeoxyribonucleotides derived from the translation initiation site, i.e., the ATG codon which encodes the first methionine of the cDNA, e.g., between the −10 and +10 regions of the Delta3 nucleotide sequence of interest, are preferred. Preferred antisense molecules of the invention are from nucleotides 328 to 348 of SEQ ID NO:1 or nucleotides 38 to 58 of SEQ ID NO:24. Non-limiting examples of preferred human and mouse antisense primers are shown below:

```
                                      (SEQ ID NO: 16)
5' TGCCGCCATCCCTCGGGGCGT 3'
(complement to nucleotides 326-346 of
SEQ ID NO: 1)

(SEQ ID NO: 17)
5' GGACGCTGCCGCCATCCCCT 3'
(complement to nucleotides 333-352 of
SEQ ID NO: 1)

(SEQ ID NO: 18)
5' GGACGCTGCCGCCATCCCCTCGGGGCGT 3'
(complement to nucleotides 326-352 of
SEQ ID NO:1)

(SEQ ID NO: 16)
5' CTCCGGGACGCAGGCGTCATCCCT 3'
(complement to nucleotides 38-58 of SEQ ID NO: 24)

(SEQ ID NO: 48)
5' ACAGGCGCTCCGGGACGCAGGCGTCATCC 3'
(complement to nucleotides 40-65 of SEQ ID NO: 24)
```

Antisense approaches involve the design of oligonucleotides (either DNA or RNA) that are complementary to Delta3 mRNA. The antisense oligonucleotides will bind to the Delta3 mRNA transcripts and prevent translation. Absolute complementarity, although preferred, is not required. A sequence "complementary" to a portion of an RNA, as referred to herein, means a sequence having sufficient complementarity to be able to hybridize with the RNA, forming a stable duplex; in the case of double-stranded antisense nucleic acids, a single strand of the duplex DNA may thus be tested, or triplex formation may be assayed. The ability to hybridize will depend on both the degree of complementarity and the length of the antisense nucleic acid. Generally, the longer the hybridizing nucleic acid, the more base mismatches with an RNA it may contain and still form a stable duplex (or triplex, as the case may be). One skilled in the art can ascertain a tolerable degree of mismatch by use of standard procedures to determine the melting point of the hybridized complex.

Oligonucleotides that are complementary to the 5' end of the message, e.g., the 5' untranslated sequence up to and including the AUG initiation codon, should work most efficiently at inhibiting translation. However, sequences complementary to the 3' untranslated sequences of mRNAs have recently been shown to be effective at inhibiting translation of mRNAs as well. (Wagner, R. (1994) Nature 372:333). Therefore, oligonucleotides complementary to either the 5' or 3' untranslated, non-coding regions of a Delta3 gene could be used in an antisense approach to inhibit translation of endogenous Delta3 mRNA. Oligonucleotides complementary to the 5' untranslated region of the mRNA should include the complement of the AUG start codon. Antisense oligonucleotides complementary to mRNA coding regions are less efficient inhibitors of translation but could be used in accordance with the invention. Whether designed to hybridize to the 5', 3' or coding region of Delta3 mRNA, antisense nucleic acids should be at least six nucleotides in length, and are preferably oligonucleotides ranging from 6 to about 50 nucleotides in length. In certain embodiments, the oligonucleotide is at least 10 nucleotides, at least 17 nucleotides, at least 25 nucleotides, or at least 50 nucleotides.

Regardless of the choice of target sequence, it is preferred that in vitro studies are first performed to quantitate the ability of the antisense oligonucleotide to quantitate the ability of the antisense oligonucleotide to inhibit gene expression. It is preferred that these studies utilize controls that distinguish between antisense gene inhibition and nonspecific biological effects of oligonucleotides. It is also preferred that these studies compare levels of the target RNA or protein with that of an internal control RNA or protein. Additionally, it is envisioned that results obtained using the antisense oligonucleotide are compared with those obtained using a control oligonucleotide. It is preferred that the control oligonucleotide is of approximately the same length as the test oligonucleotide and that the nucleotide sequence of the oligonucleotide differs from the antisense sequence no more than is necessary to prevent specific hybridization to the target sequence.

The oligonucleotides can be DNA or RNA or chimeric mixtures or derivatives or modified versions thereof, single-stranded or double-stranded. The oligonucleotide can be modified at the base moiety, sugar moiety, or phosphate backbone, for example, to improve stability of the molecule, hybridization, etc. The oligonucleotide may include other appended groups such as peptides (e.g., for targeting host cell receptors in vivo), or agents facilitating transport across the cell membrane (see, e.g., Letsinger et al. (1989) Proc. Natl. Acad. Sci. U.S.A. 86:6553-6556; Lemaitre et al. (1987) Proc. Natl. Acad. Sci. USA 84:648-652; PCT Publication NO: WO 88/09810, Dec. 15, 1988) or the blood-brain barrier (see, e.g., PCT Publication NO: WO 89/10134, Apr. 25, 1988), hybridization-triggered cleavage agents. (See, e.g., Krol et al. (1988) BioTechniques 6:958-976) or intercalating agents. (See, e.g., Zon (1988) Pharm. Res. 5:539-549). To this end, the oligonucleotide may be conjugated to another molecule, e.g., a peptide, hybridization triggered cross-linking agent, transport agent, hybridization-triggered cleavage agent, etc.

The antisense oligonucleotide may comprise at least one modified base moiety which is selected from the group including but not limited to 5-fluorouracil, 5-bromouracil, 5-chlorouracil, 5-iodouracil, hypoxanthine, xantine, 4-acetylcytosine, 5-(carboxyhydroxylmethyl) uracil, 5-carboxymethylaminomethyl-2-thiouridine, 5-carboxymethylaminomethyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-N-6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid (v), 5-methyl-2-thiouracil, 3-(3-amino-3-N-2-carboxypropyl) uracil, (acp3)w, and 2,6-diaminopurine.

The antisense oligonucleotide may also comprise at least one modified sugar moiety selected from the group including but not limited to arabinose, 2-fluoroarabinose, xylulose, and hexose.

In yet another embodiment, the antisense oligonucleotide comprises at least one modified phosphate backbone selected from the group consisting of a phosphorothioate, a phosphorodithioate, a phosphoramidothioate, a phosphoramidate, a phosphordiamidate, a methylphosphonate, an alkyl phosphotriester, and a formacetal or analog thereof.

In yet another embodiment, the antisense oligonucleotide is an α-anomeric oligonucleotide. An α-anomeric oligonucleotide forms specific double-stranded hybrids with complementary RNA in which, contrary to the usual β-units, the strands run parallel to each other (Gautier et al. (1987) Nucl. Acids Res. 15:6625-6641). The oligonucleotide is a 2'-O-methylribonucleotide (Inoue et al. (1987) Nucl. Acids Res. 15:6131-6148), or a chimeric RNA-DNA analogue (Inoue et al. (1987) FEBS Lett. 215:327-330).

Oligonucleotides of the invention may be synthesized by standard methods known in the art, e.g. by use of an automated DNA synthesizer (such as are commercially available from Biosearch, Applied Biosystems, etc.). As examples, phosphorothioate oligonucleotides may be synthesized by the method of Stein et al. (1988, Nucl. Acids Res. 16:3209), methylphosphonate oligonucleotides can be prepared by use of controlled pore glass polymer supports (Sarin et al. (1988) Proc. Natl. Acad. Sci. U.S.A. 85:7448-7451), etc.

While antisense nucleic acids complementary to the coding region sequence could be used, those complementary to the transcribed untranslated region are preferred. Antisense nucleic acids overlapping the site of initiation of translation are even more preferred. For example, antisense oligonucleotides as set forth below can be utilized in accordance with the invention.

```
5' TCAATCTGGCTCTGTTCGCG 3'          (SEQ ID NO: 19)
(complement to nucleotides 284-303
of SEQ ID NO: 1)

5' CGCTCTCTCCACCCGCGGGCCCTCAA 3'    (SEQ ID NO: 20)
(complement to nucleotides 300-325
of SEQ ID NO: 1)

5' GGTGTCCTCTCCACCGGACGCGTGGG 3'    (SEQ ID NO: 49)
(complement to nucleotides 6-31 of
SEQ ID NO: 24)

5' GTCCTCTCCACCGGACGCGTGG 3'        (SEQ ID NO: 50)
(complement to nucleotides 6-28 of
SEQ ID NO: 24)
```

The antisense molecules should be delivered to cells which express the Delta3 in vivo. A number of methods have been developed for delivering antisense DNA or RNA to cells; e.g., antisense molecules can be injected directly into the tissue site, or modified antisense molecules, designed to target the desired cells (e.g., antisense linked to peptides or antibodies that specifically bind receptors or antigens expressed on the target cell surface) can be administered systematically.

However, it is often difficult to achieve intracellular concentrations of the antisense sufficient to suppress translation on endogenous mRNAs. Therefore a preferred approach utilizes a recombinant DNA construct in which the antisense oligonucleotide is placed under the control of a strong pol III or pol II promoter. The use of such a construct to transfect target cells in the patient will result in the transcription of sufficient amounts of single stranded RNAs that will form complementary base pairs with the endogenous Delta3 transcripts and thereby prevent translation of the Delta3 mRNA. For example, a vector can be introduced in vivo such that it is taken up by a cell and directs the transcription of an antisense RNA. Such a vector can remain episomal or become chromosomally integrated, as long as it can be transcribed to produce the desired antisense RNA. Such vectors can be constructed by recombinant DNA technology methods standard in the art. Vectors can be plasmid, viral, or others known in the art, used for replication and expression in mammalian cells. Expression of the sequence encoding the antisense RNA can be by any promoter known in the art to act in mammalian, preferably human cells. Such promoters can be inducible or constitutive. Such promoters include but are not limited to: the SV40 early promoter region (Bernoist and Chambon (1981) Nature 290:304-310), the promoter contained in the 3' long terminal repeat of Rous sarcoma virus (Yamamoto et al. (1980) Cell 22:787-797), the herpes thymidine kinase promoter (Wagner et al. (1981) Proc. Natl. Acad. Sci. U.S.A. 78:1441-1445), the regulatory sequences of the metallothionein gene (Brinster et al. (1982) Nature 296:39-42), etc. Any type of plasmid, cosmid, YAC or viral vector can be used to prepare the recombinant DNA construct which can be introduced directly into the tissue site; e.g., the choroid plexus or hypothalamus. Alternatively, viral vectors can be used which selectively infect the desired tissue; (e.g., for brain, herpesvirus vectors may be used), in which case administration may be accomplished by another route (e.g., systematically).

Likewise, the antisense constructs of the present invention, by antagonizing the normal biological activity of one of the Delta3 proteins, can be used in the modulation of cellular activity both in vivo and for ex vivo tissue cultures.

Furthermore, the anti-sense techniques (e.g., microinjection of antisense molecules, or transfection with plasmids whose transcripts are anti-sense with regard to a Delta3 mRNA or gene sequence) can be used to investigate the role of Delta3 in developmental events, as well as the normal cellular function of Delta3 in adult tissue. Such techniques can be utilized in cell culture, but can also be used in the creation of transgenic animals, as detailed below.

Ribozyme molecules designed to catalytically cleave Delta3 mRNA transcripts can also be used to prevent translation of mRNA and expression of Delta3. (See, e.g., PCT International Publication WO 94/11364, published Oct. 4, 1990; Sarver et al., 1990, Science 247:1222-1225). Ribozymes are enzymatic RNA molecules capable of catalyzing the specific cleavage of RNA. The mechanism of ribozyme action involves sequence specific hybridization of the ribozyme molecule to complementary target RNA, followed by an endonucleolytic cleavage. The composition of ribozyme molecules must include one or more sequences complementary to the target gene mRNA, and must include the well known catalytic sequence responsible for mRNA cleavage. For this sequence, see U.S. Pat. No. 5,093,246. As such within the scope of the invention are engineered hammerhead motif ribozyme molecules that specifically and efficiently catalyze endonucleolytic cleavage of RNA sequences encoding Delta3 proteins.

Specific ribozyme cleavage sites within any potential RNA target are initially identified by scanning the molecule of interest for ribozyme cleavage sites which include the following sequences, GUA, GUU and GUC. Once identified, short RNA sequences of between 15 and 20 ribonucleotides corresponding to the region of the target gene containing the cleavage site may be evaluated for predicted structural features, such as secondary structure, that may render the oligonucleotide sequence unsuitable. The suitability of candidate sequences may also be evaluated by testing their accessibility to hybridization with complementary oligonucleotides, using ribonuclease protection assays.

While ribozymes that cleave mRNA at site specific recognition sequences can be used to destroy Delta3 mRNAs, the use of hammerhead ribozymes is preferred. Hammerhead ribozymes cleave mRNAs at locations dictated by flanking regions that form complementary base pairs with the target mRNA. The sole requirement is that the target mRNA have the following sequence of two bases: 5'-UG-3'. The construction and production of hammerhead ribozymes is well known in the art and is described more fully in Haseloff and Gerlach (1988) Nature 334:585-591. There are hundreds of potential hammerhead ribozyme cleavage sites within the nucleotide sequence of human Delta3 cDNA. Preferably the ribozyme is engineered so that the cleavage recognition site is located near the 5' end of the Delta3 mRNA; i.e., to increase efficiency and minimize the intracellular accumulation of non-functional mRNA transcripts.

The ribozymes of the present invention also include RNA endoribonucleases (hereinafter "Cech-type ribozymes") such as the one which occurs naturally in Tetrahymena Thermophila (known as the UVS, or L-19 IVS RNA) and which has been extensively described by Thomas Cech and collaborators (Zaug, et al. (1984) Science, 224:574-578; Zaug and Cech (1986) Science, 231:470-475; Zaug, et al. (1986) Nature 324:429-433; PCT Publication WO 88/04300; Been & Cech (1986) Cell 47:207-216). The Cech-type ribozymes have an eight base pair active site which hybridizes to a target RNA sequence whereafter cleavage of the target RNA takes place. The invention encompasses those Cech-type ribozymes which target eight base-pair active site sequences that are present in Delta3.

As in the antisense approach, the ribozymes can be composed of modified oligonucleotides (e.g., for improved stability, targeting, etc.) and should be delivered to cells which express the Delta3 in vivo e.g., hypothalamus and/or the choroid plexus. A preferred method of delivery involves using a DNA construct "encoding" the ribozyme under the control of a strong constitutive pol III or pol II promoter, so that transfected cells will produce sufficient quantities of the ribozyme to destroy endogenous Delta3 messages and inhibit translation. Because ribozymes unlike antisense molecules, are catalytic, a lower intracellular concentration is required for efficiency.

Endogenous Delta3 gene expression can also be reduced by inactivating or "knocking out" the Delta3 gene or its promoter using targeted homologous recombination. (e.g., see Smithies et al. (1985) Nature 317:230-234; Thomas & Capecchi (1987) Cell 51:503-512; Thompson et al. (1989) Cell 5:313-321). For example, a mutant, non-functional Delta3 (or a completely unrelated DNA sequence) flanked by DNA homologous to the endogenous Delta3 gene (either the coding regions or regulatory regions of the Delta3 gene) can be used, with or without a selectable marker and/or a negative selectable marker, to transfect cells that express Delta3 in vivo. Insertion of the DNA construct, via targeted homologous recombination, results in inactivation of the Delta3 gene. Such approaches are particularly suited in the agricultural field where modifications to ES (embryonic stem) cells can be used to generate animal offspring with an inactive Delta3 (e.g., see Thomas & Capecchi (1987) and Thompson (1989), supra). However this approach can be adapted for use in humans provided the recombinant DNA constructs are directly administered or targeted to the required site in vivo using appropriate viral vectors, e.g., herpes virus vectors.

Alternatively, endogenous Delta3 gene expression can be reduced by targeting deoxyribonucleotide sequences complementary to the regulatory region of the Delta3 gene (i.e., the Delta3 promoter and/or enhancers) to form triple helical structures that prevent transcription of the Delta3 gene in target cells in the body. (See generally, Helene, C. (1991) *Anticancer Drug Des.* 6(6):569-84; Helene, C., et al. (1992) *Ann. N.Y. Acad. Sci.* 660:27-36; and Maher, L. J. (1992) Bioassays 14(12):807-15).

Nucleic acid molecules to be used in triple helix formation for the inhibition of transcription are preferably single stranded and composed of deoxyribonucleotides. The base composition of these oligonucleotides should promote triple helix formation via Hoogsteen base pairing rules, which generally require sizable stretches of either purines or pyrimidines to be present on one strand of a duplex. Nucleotide sequences may be pyrimidine-based, which will result in TAT and CGC triplets across the three associated strands of the resulting triple helix. The pyrimidine-rich molecules provide base complementarity to a purine-rich region of a single strand of the duplex in a parallel orientation to that strand. In addition, nucleic acid molecules may be chosen that are purine-rich, for example, containing a stretch of G residues. These molecules will form a triple helix with a DNA duplex that is rich in GC pairs, in which the majority of the purine residues are located on a single strand of the targeted duplex, resulting in CGC triplets across the three strands in the triplex.

Alternatively, the potential sequences that can be targeted for triple helix formation may be increased by creating a so called "switchback" nucleic acid molecule. Switchback molecules are synthesized in an alternating 5'-3',3'-5' manner, such that they base pair with first one strand of a duplex and then the other, eliminating the necessity for a sizable stretch of either purines or pyrimidines to be present on one strand of a duplex.

Antisense RNA and DNA, ribozyme, and triple helix molecules of the invention may be prepared by any method known in the art for the synthesis of DNA and RNA molecules. These include techniques for chemically synthesizing oligo-deoxyribonucleotides and oligoribonucleotides well known in the art such as for example solid phase phosphoramidite chemical synthesis. Alternatively, RNA molecules may be generated by in vitro and in vivo transcription of DNA sequences encoding the antisense RNA molecule. Such DNA sequences may be incorporated into a wide variety of vectors which incorporate suitable RNA polymerase promoters such as the T7 or SP6 polymerase promoters. Alternatively, antisense cDNA constructs that synthesize antisense RNA constitutively or inducibly, depending on the promoter used, can be introduced stably into cell lines.

Moreover, various well-known modifications to nucleic acid molecules may be introduced as a means of increasing intracellular stability and half-life. Possible modifications include but are not limited to the addition of flanking sequences of ribonucleotides or deoxyribonucleotides to the 5' and/or 3' ends of the molecule or the use of phosphorothioate or 2' O-methyl rather than phosphodiesterase linkages within the oligodeoxyribonucleotide backbone.

Delta3, FTHMA-070, Tango85. Tango77. SPOIL. NEOKINE, Tanzo129 and A259 Recombinant Expression Vectors and Host Cells Another aspect of the invention pertains to vectors, preferably expression vectors, containing a nucleic acid encoding Delta3, FTHMA-070, Tango85, Tango77, SPOIL, NEOKINE, Tango129 or A259 (or a portion thereof). As used herein, the term "vector" refers to a nucleic acid molecule capable of transporting another nucleic acid to which it has been linked. One type of vector is a "plasmid", which refers to a circular double stranded DNA loop into which additional DNA segments can be ligated. Another type of vector is a viral vector, wherein additional DNA segments can be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors, expression vectors, are capable of directing the expression of genes to which they are operatively linked. In general, expression vectors of utility in recombinant DNA techniques are often in the form of plasmids (vectors). However, the invention is intended to include such other forms of expression vectors, such as viral vectors (e.g., replication defective retroviruses, adenoviruses and adeno-associated viruses), which serve equivalent functions.

The recombinant expression vectors of the invention comprise a nucleic acid of the invention in a form suitable for expression of the nucleic acid in a host cell, which means that the recombinant expression vectors include one or more regulatory sequences, selected on the basis of the host cells to be used for expression, which is operatively linked to the nucleic acid sequence to be expressed. Within a recombinant expression vector, "operably linked" is intended to mean that the nucleotide sequence of interest is linked to the regulatory sequence(s) in a manner which allows for expression of the nucleotide sequence (e.g., in an in vitro transcription/translation system or in a host cell when the vector is introduced into the host cell). The term "regulatory sequence" is intended to include promoters, enhancers and other expression control elements (e.g., polyadenylation signals). Such regulatory sequences are described, for example, in Goeddel; *Gene Expression Technology: Methods in Enzymology* 185, Academic Press, San Diego, Calif. (1990). Regulatory sequences include those which direct constitutive expression of a nucleotide sequence in many types of host cell and those which direct expression of the nucleotide sequence only in certain host cells (e.g., tissue-specific regulatory sequences). It will be appreciated by those skilled in the art that the design of the expression vector can depend on such factors as the choice of the host cell to be transformed, the level of expression of protein desired, etc. The expression vectors of the invention can be introduced into host cells to thereby produce proteins or peptides, including fusion proteins or peptides, encoded by nucleic acids as described herein (e.g., Delta3, FTHMA-070, Tango85, Tango77, SPOIL, NEOKINE, Tango129 or A259 proteins, mutant forms of Delta3, FTHMA-070, Tango85, Tango77, SPOIL, NEOKINE, Tango129 or A259, fusion proteins, etc.).

The recombinant expression vectors of the invention can be designed for expression of Delta3, FTHMA-070, Tango85, Tango77, SPOIL, NEOKINE, Tango129 or A259 in prokaryotic or eukaryotic cells, e.g., bacterial cells such as *E. coli*, insect cells (using baculovirus expression vectors) yeast cells or mammalian cells. Suitable host cells are discussed further in Goeddel, *Gene Expression Technology: Methods in Enzymology* 185, Academic Press, San Diego, Calif. (1990). Alternatively, the recombinant expression vector can be transcribed and translated in vitro, for example using T7 promoter regulatory sequences and T7 polymerase.

Expression of proteins in prokaryotes is most often carried out in *E. coli* with vectors containing constitutive or inducible promoters directing the expression of either fusion or non-fusion proteins. Fusion vectors add a number of amino acids to a protein encoded therein, usually to the amino terminus of the recombinant protein. Such fusion vectors typically serve three purposes: 1) to increase expression of recombinant protein; 2) to increase the solubility of the recombinant protein; and 3) to aid in the purification of the recombinant protein by acting as a ligand in affinity purification. Often, in fusion expression vectors, a proteolytic cleavage site is introduced at the junction of the fusion moiety and the recombinant protein to enable separation of the recombinant protein from the fusion moiety subsequent to purification of the fusion protein. Such enzymes, and their cognate recognition sequences, include Factor Xa, thrombin and enterokinase. Typical fusion expression vectors include pGEX (Pharmacia Biotech Inc; Smith and Johnson (1988) *Gene* 67:31-40), pMAL (New England Biolabs, Beverly, Mass.) and pRIT5 (Pharmacia, Piscataway, N.J.) which fuse glutathione S-transferase (GST), maltose E binding protein, or protein A, respectively, to the target recombinant protein.

Examples of suitable inducible non-fusion *E. coli* expression vectors include pTrc (Amann et al., (1988) *Gene* 69:301-315) and pET 11d (Studier et al., *Gene Expression Technology: Methods in Enzymology* 185, Academic Press, San Diego, Calif. (1990) 60-89). Target gene expression from the pTrc vector relies on host RNA polymerase transcription from a hybrid trp-lac fusion promoter. Target gene expression from the pET 11d vector relies on transcription from a T7 gn10-lac fusion promoter mediated by a coexpressed viral RNA polymerase (T7 gn1). This viral polymerase is supplied by host strains BL21(DE3) or HMS174(DE3) from a resident λ prophage harboring a T7 gn1 gene under the transcriptional control of the lacUV 5 promoter.

One strategy to maximize recombinant protein expression in *E. coli* is to express the protein in a host bacteria with an impaired capacity to proteolytically cleave the recombinant protein (Gottesman, *Gene Expression Technology: Methods in Enzymology* 185, Academic Press, San Diego, Calif. (1990) 119-128). Another strategy is to alter the nucleic acid sequence of the nucleic acid to be inserted into an expression vector so that the individual codons for each amino acid are those preferentially utilized in *E. coli* (Wada et al. (1992) *Nucleic Acids Res.* 20:2111-2118). Such alteration of nucleic acid sequences of the invention can be carried out by standard DNA synthesis techniques.

In another embodiment, the Delta3, FTHMA-070, Tango85, Tango77, SPOIL, NEOKINE, Tango129 or A259 expression vector is a yeast expression vector. Examples of vectors for expression in yeast *S. cerivisae* include pYepSec1 (Baldari et al. (1987) *EMBO J.* 6:229-234), pMFa (Kurjan and Herskowitz, (1982) *Cell* 30:933-943), pJRY88 (Schultz et al. (1987) *Gene* 54:113-123), pYES2 (Invitrogen Corporation, San Diego, Calif.), and picZ (InVitrogen Corp, San Diego, Calif.).

Alternatively, Delta3, FTHMA-070, Tango85, Tango77, SPOIL, NEOKINE, Tango129 or A259 can be expressed in insect cells using baculovirus expression vectors. Baculovirus vectors available for expression of proteins in cultured insect cells (e.g., Sf 9 cells) include the pAc series (Smith et al. (1983) *Mol. Cell. Biol.* 3:2156-2165) and the pVL series (Lucklow and Summers (1989) Virology 170:31-39).

In yet another embodiment, a nucleic acid of the invention is expressed in mammalian cells using a mammalian expression vector. Examples of mammalian expression vectors include pCDM8 (Seed (1987) *Nature* 329:840) and pMT2PC (Kaufman et al. (1987) *EMBO J.* 6:187-195). When used in mammalian cells, the expression vector's control functions are often provided by viral regulatory elements. For example, commonly used promoters are derived from polyoma, Adenovirus 2, cytomegalovirus and Simian Virus 40. For other suitable expression systems for both prokaryotic and eukaryotic cells see chapters 16 and 17 of Sambrook et al. (1989) Cold Spring Harbor Laboratory(supra).

In another embodiment, the recombinant mammalian expression vector is capable of directing expression of the nucleic acid preferentially in a particular cell type (e.g., tissue-specific regulatory elements are used to express the nucleic acid). Tissue-specific regulatory elements are known in the art. Non-limiting examples of suitable tissue-specific promoters include the albumin promoter (liver-specific; Pinkert et al. (1987) *Genes Dev.* 1:268-277), lymphoid-specific promoters (Calame and Eaton (1988) *Adv. Immunol.* 43:235-275), in particular promoters of T cell receptors (Winoto and Baltimore (1989) *EMBO J.* 8:729-733) and immunoglobulins (Banerji et al. (1983) *Cell* 33:729-740; Queen and Baltimore (1983) *Cell* 33:741-748), neuron-specific promoters (e.g., the neurofilament promoter; Byrne and Ruddle (1989) *Proc. Natl. Acad. Sci. USA* 86:5473-5477), pancreas-specific promoters (Edlund et al. (1985) *Science* 230:912-916), and mammary gland-specific promoters (e.g., milk whey promoter; U.S. Pat. No. 4,873,316 and European Application Publication No. 264,166). Developmentally-regulated promoters are also encompassed, for example the murine hox promoters (Kessel and Gruss (1990) *Science* 249:374-379) and the α-fetoprotein promoter (Campes and Tilghman (1989) *Genes Dev.* 3:537-546).

The invention further provides a recombinant expression vector comprising a DNA molecule of the invention cloned into the expression vector in an antisense orientation. That is, the DNA molecule is operatively linked to a regulatory sequence in a manner which allows for expression (by transcription of the DNA molecule) of an RNA molecule which is antisense to Delta3, FTHMA-070, Tango85, Tango77, SPOIL, NEOKINE, Tango129 or A259 mRNA. Regulatory sequences operatively linked to a nucleic acid cloned in the antisense orientation can be chosen which direct the continuous expression of the antisense RNA molecule in a variety of cell types, for instance viral promoters and/or enhancers, or regulatory sequences can be chosen which direct constitutive, tissue specific or cell type specific expression of antisense RNA. The antisense expression vector can be in the form of a recombinant plasmid, phagemid or attenuated virus in which antisense nucleic acids are produced under the control of a high efficiency regulatory region, the activity of which can be determined by the cell type into which the vector is introduced. For a discussion of the regulation of gene expression using antisense genes See Weintraub et al., *Reviews—Trends in Genetics*, Vol. 1(1) 1986.

Another aspect of the invention pertains to host cells into which a recombinant expression vector of the invention has been introduced.

Another aspect of the invention pertains to host cells into which a SPOIL nucleic acid molecule of the invention is introduced, e.g., a SPOIL nucleic acid molecule within a recombinant expression vector or a SPOIL nucleic acid molecule in a form suitable for homologous recombination in the genome of a host cell (e.g., a SPOIL nucleic acid molecule which includes SPOIL nucleotide sequences and additional 5' and 3' flanking sequences necessary for homologous recombination).

The terms "host cell" and "recombinant host cell" are used interchangeably herein. It is understood that such terms refer not only to the particular subject cell but to the progeny or potential progeny of such a cell. Because certain modifications may occur in succeeding generations due to either mutation or environmental influences, such progeny may not, in fact, be identical to the parent cell, but are still included within the scope of the term as used herein.

A host cell can be any prokaryotic or eukaryotic cell. For example, Delta3, FTHMA-070, Tango85, Tango77, SPOIL, NEOKINE, Tango129 or A259 protein can be expressed in bacterial cells such as E. coli, insect cells, yeast or mammalian cells (such as Chinese hamster ovary cells (CHO) or COS cells). Other suitable host cells are known to those skilled in the art.

Vector DNA can be introduced into prokaryotic or eukaryotic cells via conventional transformation or transfection techniques. As used herein, the terms "transformation" and "transfection" are intended to refer to a variety of art-recognized techniques for introducing foreign nucleic acid (e.g., DNA) into a host cell, including calcium phosphate or calcium chloride co-precipitation, DEAE-dextran-mediated transfection, lipofection, or electroporation. Suitable methods for transforming or transfecting host cells can be found in Sambrook, et al. (supra), and other laboratory manuals.

For stable transfection of mammalian cells, it is known that, depending upon the expression vector and transfection technique used, only a small fraction of cells may integrate the foreign DNA into their genome. In order to identify and select these integrants, a gene that encodes a selectable marker (e.g., resistance to antibiotics) is generally introduced into the host cells along with the gene of interest. Preferred selectable markers include those which confer resistance to drugs, such as G418, hygromycin and methotrexate. Nucleic acid encoding a selectable marker can be introduced into a host cell on the same vector as that encoding Delta3, FTHMA-070, Tango85, Tango77, SPOIL, NEOKINE, Tango129 or A259 or can be introduced on a separate vector. Cells stably transfected with the introduced nucleic acid can be identified by drug selection (e.g., cells that have incorporated the selectable marker gene will survive, while the other cells die).

In another embodiment, the expression characteristics of an endogenous (e.g., Delta3) nucleic acid within a cell, cell line or microorganism may be modified by inserting a DNA regulatory element heterologous to the endogenous gene of interest into the genome of a cell, stable cell line or cloned microorganism such that the inserted regulatory element is operatively linked with the endogenous gene (e.g., Delta3) and controls, modulates or activates the endogenous gene. For example, endogenous Delta3 which is normally "transcriptionally silent", i.e., Delta3 which is normally not expressed, or is expressed only at very low levels in a cell line or microorganism, may be activated by inserting a regulatory element which is capable of promoting the expression of a normally expressed gene product in that cell line or microorganism. Alternatively, transcriptionally silent, endogenous Delta3 may be activated by insertion of a promiscuous regulatory element that works across cell types.

A heterologous regulatory element may be inserted into a stable cell line or cloned microorganism, such that it is operatively linked with and activates expression of endogenous Delta3, using techniques, such as targeted homologous recombination, which are well known to those of skill in the art, and described e.g., in Chappel, U.S. Pat. No. 5,272,071, incorporated herein by reference in its entirety; PCT publication NO: WO 91/06667, published May 16, 1991.

A host cell of the invention, such as a prokaryotic or eukaryotic host cell in culture, can be used to produce (i.e., express) Delta3, FTHMA-070, Tango85, Tango77, SPOIL, NEOKINE, Tango129 or A259 protein. Accordingly, the invention further provides methods for producing Delta3, FTHMA-070, Tango85, Tango77, SPOIL, NEOKINE, Tango 129 or A259 protein using the host cells of the invention. In one embodiment, the method comprises culturing the host cell of invention (into which a recombinant expression vector encoding Delta3, FTHMA-070, Tango85, Tango77, SPOIL, NEOKINE, Tango129 or A259 has been introduced) in a suitable medium such that Delta3, FTHMA-070, Tango85, Tango77, SPOIL, NEOKINE, Tango129 or A259 protein is produced. In another embodiment, the method further comprises isolating Delta3, FTHMA-070, Tango85, Tango77, SPOIL, NEOKINE, Tango129 or A259 from the medium or the host cell.

The host cells of the invention can also be used to produce nonhuman transgenic animals. For example, in one embodiment, a host cell of the invention is a fertilized oocyte or an embryonic stem cell into which Delta3, FTHMA-070, Tango85, Tango77, SPOIL, NEOKINE, Tango129 or A259-coding sequences have been introduced. Such host cells can then be used to create non-human transgenic animals in which exogenous Delta3, FTHMA-070, Tango85, Tango77, SPOIL, NEOKINE, Tango129 or A259 sequences have been introduced into their genome or homologous recombinant animals in which endogenous Delta3, FTHMA-070, Tango85, Tango77, SPOIL, NEOKINE, Tango129 or A259 sequences have been altered. Such animals are useful for studying the function and/or activity of Delta3, FTHMA-070, Tango85, Tango77, SPOIL, NEOKINE, Tango129 or A259 and for identifying and/or evaluating modulators of FTHMA-070, Tango85, Tango77, SPOIL, NEOKINE, Tango129 or A259 activity. As used herein, a "transgenic animal" is a non-human animal, preferably a mammal, more preferably a rodent such as a rat or mouse, in which one or more of the cells of the animal includes a transgene. Other examples of transgenic animals include non-human primates, sheep, dogs, cows, goats, chickens, amphibians, etc. A transgene is exogenous DNA which is integrated into the genome of a cell from which a transgenic animal develops and which remains in the genome of the mature animal, thereby directing the expression of an encoded gene product in one or more cell types or tissues of the transgenic animal. As used herein, an "homologous recombinant animal" is a non-human animal, preferably a mammal, more preferably a mouse, in which an endogenous Delta3, FTHMA-070, Tango85, Tango77, SPOIL, NEOKINE, Tango129 or A259 gene has been altered by homologous recombination between the endogenous gene and an exogenous DNA molecule introduced into a cell of the animal, e.g., an embryonic cell of the animal, prior to development of the animal.

A transgenic animal of the invention can be created by introducing Delta3, FTHMA-070, Tango85, Tango77, SPOIL, NEOKINE, Tango129 or A259-encoding nucleic acid into the male pronuclei of a fertilized oocyte, e.g., by microinjection, retroviral infection, and allowing the oocyte to develop in a pseudopregnant female foster animal. The Delta3, FTHMA-070, T85 or A259 cDNA sequence can be introduced as a transgene into the genome of a non-human animal. The Tango-77 cDNA sequence e.g., that of (SEQ ID NO:71, SEQ ID NO:73, SEQ ID NO:76; SEQ ID NO:80 or the cDNA of ATCC 98807) can be introduced as a transgene into the genome of a non-human animal. The human SPOIL cDNA sequence of SEQ ID NO:101, SEQ ID NO:104, the DNA insert of the plasmid deposited with ATCC as Accession Number 98883, or the DNA insert of the plasmid deposited with ATCC as Accession Number 98984, can be introduced as a transgene into the genome of a non-human animal. The NEOKINE-1 cDNA sequence of SEQ ID NO:115 can be introduced as a transgene into the genome of a non-human animal. Alternatively, a nonhuman homologue of a human NEOKINE-1 gene, such as a mouse NEOKINE-1 gene (SEQ ID NO:118), a rat NEOKINE-1 gene (SEQ ID NO:121), or a macaque NEOKINE cDNA (SEQ ID NO:124), can be used as a transgene. The T129 cDNA sequence e.g., that of (SEQ ID NO:137 or SEQ ID NO:139) can be introduced as a transgene into the genome of a non-human animal.

Alternatively, a nonhuman homologue of the human Delta3, FTHMA-070, Tango85, Tango77, SPOIL, NEOKINE, Tango129 or A259 gene, such as a mouse Delta3, FTHMA-070, Tango85, Tango77, SPOIL, NEOKINE, Tango129 or A259 gene, can be isolated based on hybridization to the human Delta3, FTHMA-070, Tango85, Tango77, SPOIL, NEOKINE, Tango129 or A259 cDNA and used as a transgene. Intronic sequences and polyadenylation signals can also be included in the transgene to increase the efficiency of expression of the transgene. A tissue-specific regulatory sequence(s) can be operably linked to the Delta3, FTHMA-070, Tango85, Tango77, SPOIL, NEOKINE, Tango129 or A259 transgene to direct expression of Delta3, FTHMA-070, Tango85, Tango77, SPOIL, NEOKINE, Tango129 or A259 protein to particular cells. Methods for generating transgenic animals via embryo manipulation and microinjection, particularly animals such as mice, have become conventional in the art and are described, for example, in U.S. Pat. Nos. 4,736,866 and 4,870,009, 4,873,191 and in Hogan, *Manipulating the Mouse Embryo*, (Cold Spring Harbor Laboratory Press, Cold Spring Harbor, N.Y., 1986). Similar methods are used for production of other transgenic animals. A transgenic founder animal can be identified based upon the presence of the Delta3, FTHMA-070, Tango85, Tango77, SPOIL, NEOKINE, Tango129 or A259 transgene in its genome and/or expression of Delta3, FTHMA-070, Tango85, Tango77, SPOIL, NEOKINE, Tango129 or A259 mRNA in tissues or cells of the animals. A transgenic founder animal can then be used to breed additional animals carrying the transgene. Moreover, transgenic animals carrying a transgene encoding Delta3, FTHMA-070, Tango85, Tango77, SPOIL, NEOKINE, Tango 129 or A259 can further be bred to other transgenic animals carrying other transgenes.

To create an homologous recombinant animal, a vector is prepared which contains at least a portion of a Delta3, FTHMA-070, Tango85, Tango77, SPOIL, NEOKINE, Tango129 or A259 gene (e.g., a human or a non-human homolog of the Delta3, FTHMA-070, Tango85, Tango77, SPOIL, NEOKINE, Tango129 or A259 gene, e.g., a murine Delta3, FTHMA-070, Tango85, Tango77, SPOIL, NEOKINE, Tango129 or A259 gene) into which a deletion, addition or substitution has been introduced to thereby alter, e.g., functionally disrupt, the Delta3, FTHMA-070, Tango85, Tango77, SPOIL, NEOKINE, Tango129 or A259 gene. In a preferred embodiment, the vector is designed such that, upon homologous recombination, the endogenous Delta3, FTHMA-070, Tango85, Tango77, SPOIL, NEOKINE, Tango129 or A259 gene is functionally disrupted (i.e., no longer encodes a functional protein; also referred to as a "knock out" vector). Alternatively, the vector can be designed such that, upon homologous recombination, the endogenous Delta3, FTHMA-070, Tango85, Tango77, SPOIL, NEOKINE, Tango129 or A259 gene is mutated or otherwise altered but still encodes functional protein (e.g., the upstream regulatory region can be altered to thereby alter the expression of the endogenous Delta3, FTHMA-070, Tango85, Tango77, SPOIL, NEOKINE, Tango129 or A259 protein). In the homologous recombination vector, the altered portion of the Delta3, FTHMA-070, Tango85, Tango77, SPOIL, NEOKINE, Tango129 or A259 gene is flanked at its 5' and 3' ends by additional nucleic acid of the Delta3, FTHMA-070, Tango85, Tango77, SPOIL, NEOKINE, Tango129 or A259 gene to allow for homologous recombination to occur between the exogenous Delta3, FTHMA-070, Tango85, Tango77, SPOIL, NEOKINE, Tango129 or A259 gene carried by the vector and an endogenous Delta3, FTHMA-070, Tango85, Tango77, SPOIL, NEOKINE, Tango129 or A259 gene in an embryonic stem cell. The additional flanking Delta3, FTHMA-070, Tango85, Tango77, SPOIL, NEOKINE, Tango129 or A259 nucleic acid is of sufficient length for successful homologous recombination with the endogenous gene. Typically, several kilobases of flanking DNA (both at the 5' and 3' ends) are included in the vector (see e.g., Thomas and Capecchi (1987) *Cell* 51:503 for a description of homologous recombination vectors). The vector is introduced into an embryonic stem cell line (e.g., by electroporation) and cells in which the introduced Delta3, FTHMA-070, Tango85, Tango77, SPOIL, NEOKINE, Tango129 or A259 gene has homologously recombined with the endogenous Delta3, FTHMA-070, Tango85, Tango77, SPOIL, NEOKINE, Tango129 or A259 gene are selected (see e.g., Li et al. (1992) *Cell* 69:915). The selected cells are then injected into a blastocyst of an animal (e.g., a mouse) to form aggregation chimeras (see, e.g., Bradley in *Teratocarcinomas and Embryonic Stem Cells: A Practical Approach*, Robertson, ed. (IRL, Oxford, 1987) pp. 113-152). A chimeric embryo can then be implanted into a suitable pseudopregnant female foster animal and the embryo brought to term. Progeny harboring the homologously recombined DNA in their germ cells can be used to breed animals in which all cells of the animal contain the homologously recombined DNA by germline transmission of the transgene. Methods for constructing homologous recombination vectors and homologous recombinant animals are described further in Bradley (1991) *Current Opinion in Bio/Technology* 2:823-829 and in PCT Publication Nos. WO 90/11354, WO 91/01140, WO 92/0968, and WO 93/04169.

In another embodiment, transgenic non-humans animals can be produced which contain selected systems which allow for regulated expression of the transgene. One example of such a system is the cre/loxP recombinase system of bacteriophage P1. For a description of the cre/loxP recombinase system, see, e.g., Lakso et al. (1992) *Proc. Natl. Acad. Sci. USA* 89:6232-6236. Another example of a recombinase system is the FLP recombinase system of *Saccharomyces cerevisiae* (O'Gorman et al. (1991) *Science* 251:1351-1355. If a cre/loxP recombinase system is used to regulate expression of the transgene, animals containing transgenes encoding both the Cre recombinase and a selected protein are required. Such animals can be provided through the construction of "double" transgenic animals, e.g., by mating two transgenic animals, one containing a transgene encoding a selected protein and the other containing a transgene encoding a recombinase.

Clones of the non-human transgenic animals described herein can also be produced according to the methods described in Wilmut et al. (1997) *Nature* 385:810-813 and PCT Publication Nos. WO 97/07668 and WO 97/07669. In brief, a cell, e.g., a somatic cell, from the transgenic animal can be isolated and induced to exit the growth cycle and enter G0 phase. The quiescent cell can then be fused, e.g., through the use of electrical pulses, to an enucleated oocyte from an animal of the same species from which the quiescent cell is isolated. The reconstructed oocyte is then cultured such that it develops to morula or blastocyte and then transferred to pseudopregnant female foster animal. The offspring borne of this female foster animal will be a clone of the animal from which the cell, e.g., the somatic cell, is isolated.

Delta3 Peptides of the Present Invention

The present invention also makes available Delta3 polypeptides which are isolated from, or otherwise substantially free of other cellular proteins, especially other signal transduction factors and/or transcription factors which may normally be associated with the Delta3 polypeptide. In general, polypeptides of the invention exhibit an activity of a Delta3 protein. The invention provides various forms of Delta3 proteins, specifically including all of the Delta3 proteins encoded by a nucleic acid of the invention, as described above.

In one embodiment, a polypeptide of the invention is a polypeptide that is a variant of a polypeptide of the invention can be assayed for: (1) the ability to form protein:protein interactions with proteins in a signaling pathway of the polypeptide of the invention; (2) the ability to bind a ligand of the polypeptide of the invention; or (3) the ability to bind to an intracellular target protein of the polypeptide of the invention. In yet another preferred embodiment, the mutant polypeptide can be assayed for the ability to modulate cellular proliferation, cellular migration or chemotaxis, or cellular differentiation.

Full-length proteins or fragments corresponding to one or more particular motifs and/or domains or to arbitrary sizes, for example, at least about 5, 10, 25, 50, 75, 100, 125, 150 amino acids in length are within the scope of the present invention. The invention encompasses all proteins encoded by the nucleic acids described in the above section describing the nucleic acids of the invention.

For example, isolated Delta3 polypeptides can include all or a portion of an amino acid sequences corresponding to a Delta3 polypeptide represented in SEQ ID NOs: 2, 25, 28, 30, 32, 34, 36, 38, 40, 42, 44 or 46, or the amino acid sequence encoded by the cDNA of a clone deposited with the ATCC® as Accession Number 98348. Isolated portions of Delta3 proteins can be obtained, for example, by screening peptides recombinantly produced from the corresponding fragment of the nucleic acid encoding such peptides. In addition, fragments can be chemically synthesized using techniques known in the art such as conventional Merrifield solid phase f-Moc or t-Boc chemistry. For example, a Delta3 polypeptide of the present invention may be divided into fragments of desired length with no overlap of the fragments, or preferably divided into overlapping fragments of a desired length. The fragments can be produced (recombinantly or by chemical synthesis) and tested to identify those peptidyl fragments which can function as either agonists or antagonists of a wild-type (e.g., "authentic") Delta3 protein.

In one embodiment, the Delta3 polypeptide of the invention has an overall amino acid sequence similarity or identity of at least about 70%, at least about 75%, at least about 80%, at least about 85%, at least about 90%, at least about 95%, at least about 98%, or at least about 99% with the amino acid sequence SEQ ID NOs: 2, 25, 28, 30, 32, 34, 36, 38, 40, 42, 44 or 46, or the amino acid sequence encoded by the cDNA of a clone deposited with the ATCC® as Accession Number 98348. In a particularly preferred embodiment a Delta3 protein has the amino acid sequence SEQ ID NOs: 2, 25, 28, 30, 32, 34, 36, 38, 40, 42, 44 or 46, or the amino acid sequence of the cDNA of a clone deposited with the ATCC® as Accession Number 98348. In other particularly preferred embodiments, the Delta3 protein has a Delta3 activity.

The present invention further pertains to forms of one of the subject Delta3 polypeptides which are encoded by nucleotide sequences derived from a mammalian organism, and which have amino acid sequences evolutionarily related to the Delta3 protein represented in SEQ ID NOs: 2, 25, 28, 30, 32, 34, 36, 38, 40, 42, 44 or 46, or the amino acid sequence encoded by the cDNA of a clone deposited with the ATCC® as Accession Number 98348. Such recombinant Delta3 polypeptides can, in certain embodiments, preferably are capable of functioning in one of either role of an agonist or antagonist of at least one biological activity of a wild-type ("authentic") Delta3 protein of the appended sequence listing. The term "evolutionarily related to", with respect to amino acid sequences of human Delta3 proteins, refers to both polypeptides having amino acid sequences which have arisen naturally, and also to mutational variants of the Delta3 polypeptides which are derived, for example, by combinatorial mutagenesis. Such evolutionarily derived Delta3 polypeptides preferred by the present invention have a Delta3 activity and are at least 80% homologous and more preferably 85% identical and most preferably 90% identical with the amino acid sequence of SEQ ID NOs: 2, 25, 28, 30, 32, 34, 36, 38, 40, 42, 44 or 46, or the amino acid sequence encoded by the cDNA of a clone deposited with the ATCC® as Accession Number 98348. In a particularly preferred embodiment, a Delta3 protein comprises the amino acid coding sequence of SEQ ID NOs: 2, 25, 28, 30, 32, 34, 36, 38, 40, 42, 44 or 46, or the amino acid sequence of the cDNA of a clone deposited with the ATCC® as Accession Number 98348.

The present invention further pertains to methods of producing the subject Delta3 polypeptides. For example, a host cell transfected with a nucleic acid vector directing expression of a nucleotide sequence encoding the subject polypeptides can be cultured under appropriate conditions to allow expression of the peptide to occur. The cells may be harvested, lysed and the protein isolated. A cell culture includes host cells, media and other byproducts. Suitable media for cell culture are well known in the art. The recombinant Delta3 polypeptide can be isolated from cell culture medium, host cells, or both using techniques known in the art for purifying proteins including ion-exchange chromatography, gel filtration chromatography, ultrafiltration, electrophoresis, and immunoaffinity purification with antibodies specific for such peptide. In a preferred embodiment, the recombinant Delta3 polypeptide is a fusion protein containing a domain which facilitates its purification, such as GST fusion protein or poly(H is) fusion protein.

Moreover, it will be generally appreciated that, under certain circumstances, it may be advantageous to provide variants of one of the subject Delta3 polypeptides which function in a limited capacity as one of either a Delta3 agonist (mimetic) or a Delta3 antagonist, in order to promote or inhibit only a subset of the biological activities of the naturally-occurring form of the protein. Thus, specific biological effects can be elicited by treatment with a variant having a limited function, and with fewer side effects relative to treatment with agonists or antagonists which are directed to all of the biological activities of naturally-occurring forms of Delta3 proteins.

Variants and/or mutants of each of the subject Delta3 proteins can be generated by mutagenesis, such as by discrete point mutation(s), or by truncation. For instance, mutation can give rise to homologs which retain substantially the same, or merely a subset, of the biological activity of the Delta3 polypeptide from which it was derived. Alternatively, antagonistic forms of the protein can be generated which are able to inhibit the function of the naturally-occurring form of the protein, such as by competitively binding to a downstream or upstream member of the Delta3 cascade which includes the Delta3 protein. In addition, agonistic forms of the protein may be generated which are constitutively active.

The recombinant Delta3 polypeptides of the present invention also include homologs of the authentic Delta3 proteins, such as versions of those protein which are resistant to proteolytic cleavage, as for example, due to mutations which alter ubiquitination or other enzymatic targeting associated with the protein.

Delta3 polypeptides may also be chemically modified to create Delta3 derivatives by forming covalent or aggregate conjugates with other chemical moieties, such as glycosyl groups, lipids, phosphate, acetyl groups and the like. Covalent derivatives of Delta3 proteins can be prepared by linking the chemical moieties to functional groups on amino acid sidechains of the protein or at the N-terminus or at the C-terminus of the polypeptide.

Modification of the structure of the subject Delta3 polypeptides can be for such purposes as enhancing therapeutic or prophylactic efficacy, stability (e.g., ex vivo shelf life and resistance to proteolytic degradation in vivo), or post-translational modifications (e.g., to alter phosphorylation pattern of protein). Such modified peptides, when designed to retain at least one activity of the naturally-occurring form of the protein, or to produce specific antagonists thereof, are considered functional equivalents of the Delta3 polypeptides described in more detail herein. Such modified peptides can be produced, for instance, by amino acid substitution, deletion, or addition.

For example, it is reasonable to expect that an isolated replacement of a leucine with an isoleucine or valine, an aspartate with a glutamate, a threonine with a serine, or a similar replacement of an amino acid with a structurally related amino acid (i.e. isosteric and/or isoelectric mutations) will not have a major effect on the biological activity of the resulting molecule. Conservative replacements are those that take place within a family of amino acids that are related in their side chains. Genetically encoded amino acids can be divided into four families: (1) acidic=aspartate, glutamate; (2) basic=lysine, arginine, histidine; (3) nonpolar=alanine, valine, leucine, isoleucine, proline, phenylalanine, methionine, tryptophan; and (4) uncharged polar=glycine, asparagine, glutamine, cysteine, serine, threonine, tyrosine. In similar fashion, the amino acid repertoire can be grouped as (1) acidic=aspartate, glutamate; (2) basic=lysine, arginine histidine, (3) aliphatic=glycine, alanine, valine, leucine, isoleucine, serine, threonine, with serine and threonine optionally be grouped separately as aliphatic-hydroxyl; (4) aromatic=phenylalanine, tyrosine, tryptophan; (5) amide=asparagine, glutamine; and (6) sulfur-containing=cysteine and methionine. (See, for example, Biochemistry, 4th ed., Ed. by L. Stryer, WH Freeman and Co.: 1995). Whether a change in the amino acid sequence of a peptide results in a functional Delta3 homolog (e.g., functional in the sense that the resulting polypeptide mimics or antagonizes the wild-type form) can be readily determined by assessing the ability of the variant peptide to produce a response in cells in a fashion similar to the wild-type protein, or competitively inhibit such a response. Polypeptides in which more than one replacement has taken place can readily be tested in the same manner.

This invention further contemplates a method for generating sets of combinatorial mutants of the subject Delta3 proteins as well as truncation mutants, and is especially useful for identifying potential functional variant sequences (e.g., homologs). The purpose of screening such combinatorial libraries is to generate, for example, novel Delta3 homologs which can act as either agonists or antagonist, or alternatively, possess novel activities all together.

In one embodiment, the variegated library of Delta3 variants is generated by combinatorial mutagenesis at the nucleic acid level, and is encoded by a variegated gene library. For instance, a mixture of synthetic oligonucleotides can be enzymatically ligated into gene sequences such that the degenerate set of potential Delta3 sequences are expressible as individual polypeptides, or alternatively, as a set of larger fusion proteins (e.g., for phage display) containing the set of Delta3 sequences therein.

There are many ways by which such libraries of potential Delta3 variants can be generated from a degenerate oligonucleotide sequence. Chemical synthesis of a degenerate gene sequence can be carried out in an automatic DNA synthesizer, and the synthetic genes then ligated into an appropriate expression vector. The purpose of a degenerate set of genes is to provide, in one mixture, all of the sequences encoding the desired set of potential Delta3 sequences. The synthesis of degenerate oligonucleotides is well known in the art (see for example, Narang, S A (1983) Tetrahedron 39:3; Itakura et al. (1981) Recombinant DNA, Proc. 3rd Cleveland Sympos. Macromolecules, ed. AG Walton, Amsterdam: Elsevier ppg. 273-289; Itakura et al. (1984) Annu. Rev. Biochem. 53:323; Itakura et al. (1984) Science 198:1056; Ike et al. (1983) Nucleic Acid Res. 11:477. Such techniques have been employed in the directed evolution of other proteins (see, for example, Scott et al. (1990) Science 249:386-390; Roberts et al. (1992) PNAS 89:2429-2433; Devlin et al. (1990) Science 249: 404-406; Cwirla et al. (1990) PNAS 87: 6378-6382; as well as U.S. Pat. Nos. 5,223,409, 5,198,346, and 5,096,815).

Likewise, a library of coding sequence fragments can be provided for a Delta3 clone in order to generate a variegated population of Delta3 fragments for screening and subsequent selection of bioactive fragments. A variety of techniques are known in the art for generating such libraries, including chemical synthesis. In one embodiment, a library of coding sequence fragments can be generated by (i) treating a double stranded PCR fragment of a Delta3 coding sequence with a nuclease under conditions wherein nicking occurs only about once per molecule; (ii) denaturing the double stranded DNA; (iii) renaturing the DNA to form double stranded DNA which can include sense/antisense pairs from different nicked products; (iv) removing single stranded portions from reformed duplexes by treatment with S1 nuclease; and (v) ligating the resulting fragment library into an expression vector. By this exemplary method, an expression library can be derived which codes for N-terminal, C-terminal and internal fragments of various sizes.

A wide range of techniques are known in the art for screening gene products of combinatorial libraries made by point mutations or truncation, and for screening cDNA libraries for gene products having a certain property. Such techniques will be generally adaptable for rapid screening of the gene libraries generated by the combinatorial mutagenesis of Delta3 homologs. The most widely used techniques for screening large gene libraries typically comprises cloning the gene library into replicable expression vectors, transforming appropriate cells with the resulting library of vectors, and expressing the combinatorial genes under conditions in which detection of a desired activity facilitates relatively easy isolation of the vector encoding the gene whose product was detected. Each of the illustrative assays described below are amenable to high through-put analysis as necessary to screen large numbers of degenerate Delta3 sequences created by combinatorial mutagenesis techniques.

Combinatorial mutagenesis has a potential to generate very large libraries of mutant proteins, e.g., in the order of 1026 molecules. Combinatorial libraries of this size may be technically challenging to screen even with high throughput screening assays. To overcome this problem, a new technique has been developed recently, recrusive ensemble mutagenesis (REM), which allows one to avoid the very high proportion of non-functional proteins in a random library and simply enhances the frequency of functional proteins, thus decreasing the complexity required to achieve a useful sampling of sequence space. REM is an algorithm which enhances the frequency of functional mutants in a library when an appropriate selection or screening method is employed (Arkin and Yourvan, 1992, PNAS USA 89:7811-7815; Yourvan et al., 1992, Parallel Problem Solving from Nature, 2. In Maenner and Manderick, eds., Elsevir Publishing Co., Amsterdam, pp. 401-410; Delgrave et al., 1993, Protein Engineering 6(3): 327-331).

The invention also provides for reduction of the Delta3 proteins to generate mimetics, e.g., peptide or non-peptide agents, which are able to bind to a Delta3 protein and/or to disrupt binding of a Delta3 polypeptide of the present invention with either upstream or downstream components of a Delta/Notch signaling cascade, such as binding proteins or interactors. Thus, such mutagenic techniques as described above are also useful to map the determinants of the Delta3 proteins which participate in protein-protein interactions involved in, for example, binding of the subject Delta3 polypeptide to proteins which may function upstream (including both activators and repressors of its activity) or to proteins or nucleic acids which may function downstream of the Delta3 polypeptide, whether they are positively or negatively regulated by it, for example, Notch. To illustrate, the critical residues of a subject Delta3 polypeptide which are involved in molecular recognition of, for example, the Notch gene product or other component upstream or downstream of a Delta3 gene can be determined and used to generate Delta-derived peptidomimetics which competitively inhibit binding of the authentic Delta3 protein with that moiety. By employing, for example, scanning mutagenesis to map the amino acid residues of each of the subject Delta3 proteins which are involved in binding other extracellular proteins, peptidomimetic compounds can be generated which mimic those residues of the Delta3 protein which facilitate the interaction. Such mimetics may then be used to interfere with the normal function of a Delta3 protein. For instance, non-hydrolyzable peptide analogs of such residues can be generated using benzodiazepine (e.g., see Freidinger et al. in Peptides: Chemistry and Biology, G. R. Marshall ed., ESCOM Publisher: Leiden, Netherlands, 1988), azepine (e.g., see Huffman et al. in Peptides: Chemistry and Biology, G. R. Marshall ed., ESCOM Publisher: Leiden, Netherlands, 1988), substituted gamma lactam rings (Garvey et al. in Peptides: Chemistry and Biology, G. R. Marshall ed., ESCOM Publisher: Leiden, Netherlands, 1988), keto-methylene pseudopeptides (Ewenson et al. (1986) *J Med Chem* 29:295; and Ewenson et al. in Peptides: Structure and Function (Proceedings of the 9th American Peptide Symposium) Pierce Chemical Co. Rockland, Ill., 1985), b-turn dipeptide cores (Nagai et al. (1985) Tetrahedron Lett 26:647; and Sato et al. (1986) J Chem Soc Perkin Trans 1:1231), and b-aminoalcohols (Gordon et al. (1985) Biochem Biophys Res Commun 126:419; and Dann et al. (1986) Biochem Biophys Res Commun 134:71).

Delta3 Fusion Proteins and Immunogens.

In another embodiment, the coding sequences for the polypeptide can be incorporated as a part of a fusion gene including a nucleotide sequence encoding a different polypeptide.

In one embodiment, the Delta3 polypeptide is a Delta3-Ig polypeptide. The Delta3-Ig polypeptide can comprise the entire extracellular domain of Delta3, e.g., human Delta3, or a variant thereof. For example, a Delta3-Ig polypeptide can comprise an amino acid sequences from about amino acid 1 to about amino acid 529 of SEQ ID NO: 2 or from about amino acid 1 to about amino acid 530 of SEQ ID NO: 25. Other preferred Delta3-Ig proteins do not comprise a signal peptide and thus, preferably do not comprise about amino acid 1 to about amino acid 17 or amino acid 18 of SEQ ID NO: 2 or 25. Alternatively, a Delta3-Ig fusion protein can comprise a portion of the extracellular domain of a Delta3 protein or a variant of a portion of the extracellular domain of a Delta3 protein. Preferred portions of the extracellular domain include portions having at least one motif amino terminal to the transmembrane domain. For example a Delta3-Ig fusion protein can comprise at least one EGF-like domain. A Delta3-Ig fusion protein can further comprise a DSL domain. A Delta3-Ig fusion protein can also further comprise a signal peptide. Delta3-Ig fusion proteins can be prepared as described, e.g., in U.S. Pat. No. 5,434,131.

This type of expression system can be useful under conditions where it is desirable to produce an immunogenic fragment of a Delta3 protein. For example, the VP6 capsid protein of rotavirus can be used as an immunologic carrier protein for portions of the Delta3 polypeptide, either in the monomeric form or in the form of a viral particle. The nucleic acid sequences corresponding to the portion of a subject Delta3 protein to which antibodies are to be raised can be incorporated into a fusion gene construct which includes coding sequences for a late vaccinia virus structural protein to produce a set of recombinant viruses expressing fusion proteins comprising Delta3 epitopes as part of the virion. It has been demonstrated with the use of immunogenic fusion proteins utilizing the Hepatitis B surface antigen fusion proteins that recombinant Hepatitis B virions can be utilized in this role as well. Similarly, chimeric constructs coding for fusion proteins containing a portion of a Delta3 protein and the poliovirus capsid protein can be created to enhance immunogenicity of the set of polypeptide antigens (see, for example, EP Publication No: 0259149; and Evans et al. (1989) Nature 339:385; Huang et al. (1988) J. Virol. 62:3855; and Schlienger et al. (1992) J. Virol. 66:2).

The Multiple Antigen Peptide system for peptide-based immunization can also be utilized to generate an immunogen, wherein a desired portion of a Delta3 polypeptide is obtained directly from organo-chemical synthesis of the peptide onto an oligomeric branching lysine core (see, for example, Posnett et al. (1988) *J. Biol. Chem.* 263:1719 and Nardelli et al. (1992) *J. Immunol.* 148:914). Antigenic determinants of Delta3 proteins can also be expressed and presented by bacterial cells.

In addition to utilizing fusion proteins to enhance immunogenicity, it is widely appreciated that fusion proteins can also facilitate the expression of proteins, and accordingly, can be used in the expression of the Delta3 polypeptides of the present invention. For example, Delta3 polypeptides can be generated as glutathione-S-transferase (GST-fusion) proteins. Such GST-fusion proteins can enable easy purification of the Delta3 polypeptide, as for example by the use of glutathione-derivatized matrices (see, for example, Current Protocols in Molecular Biology, eds. Ausubel et al. (N.Y.: John Wiley & Sons, 1991)).

In another embodiment, a fusion gene coding for a purification leader sequence, such as a poly-(Mis)/enterokinase cleavage site sequence at the N-terminus of the desired portion of the recombinant protein, can allow purification of the expressed fusion protein by affinity chromatography using a $Ni^{2+}$ metal resin. The purification leader sequence can then be subsequently removed by treatment with enterokinase to provide the purified protein (e.g., see Hochuli et al. (1987) *J. Chromatography* 411:177; and Janknecht et al. *Proc. Natl. Acad. Sci. USA* 88:8972). Techniques for making fusion genes are known to those skilled in the art. Essentially, the joining of various DNA fragments coding for different polypeptide sequences is performed in accordance with conventional techniques, employing blunt-ended or stagger-ended termini for ligation, restriction enzyme digestion to provide for appropriate termini, filling-in of cohesive ends as appropriate, alkaline phosphatase treatment to avoid undesirable joining, and enzymatic ligation. In another embodiment, the fusion gene can be synthesized by conventional techniques including automated DNA synthesizers. Alternatively, PCR amplification of gene fragments can be carried out using anchor primers which give rise to complementary overhangs between two consecutive gene fragments which can subsequently be annealed to generate a chimeric gene sequence (see, for example, Current Protocols in Molecular Biology, eds. Ausubel et al. John Wiley & Sons: 1992).

Delta3 Antibodies

Another aspect of the invention pertains to an antibody that binds to a Delta3 protein; that is, to antibodies directed against a polypeptide of the invention. For example, by using immunogens derived from a Delta3 protein, e.g., based on the cDNA sequences, anti-protein/anti-peptide antisera or monoclonal antibodies can be made by standard protocols (See, for example, Antibodies: A Laboratory Manual ed. by Harlow and Lane (Cold Spring Harbor Press: 1988)). A mammal, such as a mouse, a hamster or rabbit can be immunized with an immunogenic form of the peptide (e.g., a Delta3 polypeptide or an antigenic fragment which is capable of eliciting an antibody response, or a fusion protein as described above). Techniques for conferring immunogenicity on a protein or peptide include conjugation to carriers or other techniques well known in the art. An immunogenic portion of a Delta3 protein can be administered in the presence of adjuvant. The progress of immunization can be monitored by detection of antibody titers in plasma or serum. Standard ELISA or other immunoassays can be used with the immunogen as antigen to assess the levels of antibodies.

Following immunization of an animal with an antigenic preparation of a Delta3 polypeptide, anti-Delta3 antisera can be obtained and, if desired, polyclonal anti-Delta3 antibodies isolated from the serum. To produce monoclonal antibodies, antibody-producing cells (lymphocytes) can be harvested from an immunized animal and fused by standard somatic cell fusion procedures with immortalizing cells such as myeloma cells to yield hybridoma cells. Such techniques are well known in the art, and include, for example, the hybridoma technique (originally developed by Kohler and Milstein, (1975) *Nature*, 256: 495-497), the human B cell hybridoma technique (Kozbar et al., (1983) *Immunology Today*, 4: 72), and the EBV-hybridoma technique to produce human monoclonal antibodies (Cole et al., (1985) *Monoclonal Antibodies and Cancer Therapy*, Alan R. Liss, Inc. pp. 77-96). Hybridoma cells can be screened immunochemically for production of antibodies specifically reactive with a Delta3 polypeptide of the present invention and monoclonal antibodies isolated from a culture comprising such hybridoma cells. In one embodiment anti-human Delta3 antibodies specifically react with the proteins encoded by the DNA of ATCC® Deposit Accession Number 98348.

Antibodies can be fragmented using conventional techniques and the fragments screened for utility in the same manner as described above for whole antibodies. For example, $F(ab)_2$ fragments can be generated by treating antibody with pepsin. The resulting $F(ab)_2$ fragment can be treated to reduce disulfide bridges to produce Fab fragments. The antibody of the present invention is further intended to include bispecific and chimeric molecules having affinity for a Delta3 protein conferred by at least one CDR region of the antibody.

Antibodies which specifically bind Delta3 epitopes can also be used in immunohistochemical staining of tissue samples in order to evaluate the abundance and pattern of expression of each of the subject Delta3 polypeptides. Anti-Delta3 antibodies can be used diagnostically in immuno-precipitation and immuno-blotting to detect and evaluate Delta3 protein levels in tissue as part of a clinical testing procedure. For instance, such measurements can be useful in predictive valuations of the onset or progression of neurodegenerative, neoplastic or hyperplastic disorders. Likewise, the ability to monitor Delta3 protein levels in an individual can allow determination of the efficacy of a given treatment regimen for an individual afflicted with such a disorder. The level of Delta3 polypeptides may be measured from cells in bodily fluid, such as in samples of cerebral spinal fluid or amniotic fluid, or can be measured in tissue, such as produced by biopsy. Diagnostic assays using anti-Delta3 antibodies can include, for example, immunoassays designed to aid in early diagnosis of a neurodegenerative disorder, particularly ones which are manifest at birth. Diagnostic assays using anti-Delta3 polypeptide antibodies can also include immunoassays designed to aid in early diagnosis and phenotyping neurodegenerative, neoplastic or hyperplastic disorders.

Another application of anti-Delta3 antibodies of the present invention is in the immunological screening of cDNA libraries constructed in expression vectors such as λgt11, λgt18-23, λZAP, and ORF8. Messenger libraries of this type, having coding sequences inserted in the correct reading frame and orientation, can produce fusion proteins. For instance, λgt11 will produce fusion proteins whose amino termini consist of β-galactosidase amino acid sequences and whose carboxy termini consist of a foreign polypeptide. Antigenic epitopes of a Delta3 protein, e.g., other orthologs of a particular Delta3 protein or other paralogs from the same species, can then be detected with antibodies, as, for example, reacting nitrocellulose filters lifted from infected plates with anti-Delta3 antibodies. Positive phage detected by this assay can then be isolated from the infected plate. Thus, the presence of Delta3 homologs can be detected and cloned from other animals, as can alternate isoforms (including splicing variants) from humans.

Polyclonal antibodies can be prepared as described above by immunizing a suitable subject with a polypeptide of the invention as an immunogen. Preferred polyclonal antibody compositions are ones that have been selected for antibodies directed against a polypeptide or polypeptides of the invention. Particularly preferred polyclonal antibody preparations are ones that contain only antibodies directed against a polypeptide or polypeptides of the invention. Particularly preferred immunogen compositions are those that contain no other human proteins such as, for example, immunogen compositions made using a non-human host cell for recombinant expression of a polypeptide of the invention. In such a manner, the only human epitope or epitopes recognized by the resulting antibody compositions raised against this immunogen will be present as part of a polypeptide or polypeptides of the invention.

The antibody titer in the immunized subject can be monitored over time by standard techniques, such as with an enzyme linked immunosorbent assay (ELISA) using immobilized polypeptide. If desired, the antibody molecules can be isolated from the mammal (e.g., from the blood) and further purified by well-known techniques, such as protein A chromatography to obtain the IgG fraction. Alternatively, antibodies specific for a protein or polypeptide of the invention can be selected for (e.g., partially purified) or purified by, e.g., affinity chromatography. For example, a recombinantly expressed and purified (or partially purified) protein of the invention is produced as described herein, and covalently or non-covalently coupled to a solid support such as, for example, a chromatography column. The column can then be used to affinity purify antibodies specific for the proteins of the invention from a sample containing antibodies directed against a large number of different epitopes, thereby generating a substantially purified antibody composition, i.e., one that is substantially free of contaminating antibodies. By a substantially purified antibody composition is meant, in this context, that the antibody sample contains at most only 30% (by dry weight) of contaminating antibodies directed against epitopes other than those on the desired protein or polypeptide of the invention, and preferably at most 20%, yet more preferably at most 10%, and most preferably at most 5% (by dry weight) of the sample is contaminating antibodies. A purified antibody composition means that at least 99% of the antibodies in the composition are directed against the desired protein or polypeptide of the invention.

At an appropriate time after immunization, e.g., when the specific antibody titers are highest, antibody-producing cells can be obtained from the subject and used to prepare monoclonal antibodies by standard techniques, such as the hybridoma technique originally described by Kohler and Milstein (1975) Nature 256:495-497, the human B cell hybridoma technique (Kozbor et al. (1983) Immunol. Today 4:72), the EBV-hybridoma technique (Cole et al. (1985), Monoclonal Antibodies and Cancer Therapy, Alan R. Liss, Inc., pp. 77-96) or trioma techniques. The technology for producing hybridomas is well known (see generally Current Protocols in Immunology (1994) Coligan et al. (eds.) John Wiley & Sons, Inc., New York, N.Y.). Hybridoma cells producing a monoclonal antibody of the invention are detected by screening the hybridoma culture supernatants for antibodies that bind the polypeptide of interest, e.g., using a standard ELISA assay.

Alternative to preparing monoclonal antibody-secreting hybridomas, a monoclonal antibody directed against a polypeptide of the invention can be identified and isolated by screening a recombinant combinatorial immunoglobulin library (e.g., an antibody phage display library) with the polypeptide of interest. Kits for generating and screening phage display libraries are commercially available (e.g., the Pharmacia *Recombinant Phage Antibody System*, Catalog NO: 27-9400-01; and the Stratagene *SurJZAP Phage Display Kit*, Catalog NO: 240612). Additionally, examples of methods and reagents particularly amenable for use in generating and screening antibody display library can be found in, for example, U.S. Pat. No. 5,223,409; PCT Publication No: WO 92/18619; PCT Publication No: WO 91/17271; PCT Publication No: WO 92/20791; PCT Publication No: WO 92/15679; PCT Publication No: WO 93/01288; PCT Publication No: WO 92/01047; PCT Publication No: WO 92/09690; PCT Publication No: WO 90/02809; Fuchs et al. (1991) *Bio/Technology* 9:1370-1372; Hay et al. (1992) *Hum. Antibod. Hybridomas* 3:81-85; Huse et al. (1989) *Science* 246:1275-1281; Griffiths et al. (1993) *EMBO J.* 12:725-734.

Additionally, recombinant antibodies, such as chimeric and humanized monoclonal antibodies, comprising both human and non-human portions, which can be made using standard recombinant DNA techniques, are within the scope of the invention. A chimeric antibody is a molecule in which different portions are derived from different animal species, such as those having a variable region derived from a murine mAb and a human immunoglobulin constant region. (See, e.g., Cabilly et al., U.S. Pat. No. 4,816,567; and Boss et al., U.S. Pat. No. 4,816,397, which are incorporated herein by reference in their entirety.) Humanized antibodies are antibody molecules from non-human species having one or more complementarily determining regions (CDRs) from the non-human species and a framework region from a human immunoglobulin molecule. (See, e.g., Queen, U.S. Pat. No. 5,585,089.) Such chimeric and humanized monoclonal antibodies can be produced by recombinant DNA techniques known in the art, for example using methods described in PCT Publication NO: WO 87/02671; European Patent Application 184, 187; European Patent Application 171,496; European Patent Application 173,494; PCT Publication NO: WO 86/01533; U.S. Pat. No. 4,816,567; European Patent Application 125, 023; Better et al. (1988) *Science* 240:1041-1043; Liu et al. (1987) *Proc. Natl. Acad. Sci. USA* 84:3439-3443; Liu et al. (1987) *J. Immunol.* 139:3521-3526; Sun et al. (1987) *Proc. Natl. Acad. Sci. USA* 84:214-218; Nishimura et al. (1987) *Canc. Res.* 47:999-1005; Wood et al. (1985) *Nature* 314:446-449; and Shaw et al. (1988) *J. Natl. Cancer Inst.* 80:1553-1559); Morrison (1985) *Science* 229:1202-1207; Oi et al. (1986) *Bio/Techniques* 4:214; U.S. Pat. No. 5,225,539; Jones et al. (1986) *Nature* 321:552-525; Verhoeyan et al. (1988) *Science* 239:1534; and Beidler et al. (1988) *J. Immunol.* 141: 4053-4060.

Completely human antibodies are particularly desirable for therapeutic treatment of human patients. Such antibodies can be produced, for example, using transgenic mice which are incapable of expressing endogenous immunoglobulin heavy and light chains genes, but which can express human heavy and light chain genes. The transgenic mice are immunized in the normal fashion with a selected antigen, e.g., all or a portion of a polypeptide of the invention. Monoclonal antibodies directed against the antigen can be obtained using conventional hybridoma technology. The human immunoglobulin transgenes harbored by the transgenic mice rearrange during B cell differentiation, and subsequently undergo class switching and somatic mutation. Thus, using such a technique, it is possible to produce therapeutically useful IgG, IgA and IgE antibodies. For an overview of this technology for producing human antibodies, see Lonberg and Huszar (1995, *Int. Rev. Immunol.* 13:65-93). For a detailed discussion of this technology for producing human antibodies and human monoclonal antibodies and protocols for producing such antibodies, see, e.g., U.S. Pat. Nos. 5,625,126; 5,633, 425; 5,569,825; 5,661,016; and 5,545,806. In addition, companies such as Abgenix, Inc. (Freemont, Calif.), can be engaged to provide human antibodies directed against a selected antigen using technology similar to that described above.

Completely human antibodies which recognize a selected epitope can be generated using a technique referred to as "guided selection." In this approach a selected non-human monoclonal antibody, e.g., a murine antibody, is used to guide the selection of a completely human antibody recognizing the same epitope. (Jespers et al. (1994) Bio/technology 12:899-903).

An antibody directed against a polypeptide of the invention (e.g., monoclonal antibody) can be used to isolate the polypeptide by standard techniques, such as affinity chromatography or immunoprecipitation. Moreover, such an antibody can be used to detect the protein (e.g., in a cellular lysate or cell supernatant) in order to evaluate the abundance and pattern of expression of the polypeptide. The antibodies can also be used diagnostically to monitor protein levels in tissue as part of a clinical testing procedure, e.g., to, for example, determine the efficacy of a given treatment regimen. Detection can be facilitated by coupling the antibody to a detectable substance. Examples of detectable substances include various enzymes, prosthetic groups, fluorescent materials, luminescent materials, bioluminescent materials, and radioactive materials. Examples of suitable enzymes include horseradish peroxidase, alkaline phosphatase, β-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; examples of bioluminescent materials include luciferase, luciferin, and aequorin, and examples of suitable radioactive material include $^{125}I$, $^{131}I$, $^{35}S$ or $^{3}H$.

Further, an antibody (or fragment thereof) can be conjugated to a therapeutic moiety such as a cytotoxin, a therapeutic agent or a radioactive metal ion. A cytotoxin or cytotoxic agent includes any agent that is detrimental to cells. Examples include taxol, cytochalasin B, gramicidin D, ethidium bromide, emetine, mitomycin, etoposide, tenoposide, vincristine, vinblastine, colchicin, doxorubicin, daunorubicin, dihydroxy anthracin dione, mitoxantrone, mithramycin, actinomycin D, 1-dehydrotestosterone, glucocorticoids, procaine, tetracaine, lidocaine, propranolol, and puromycin and analogs or homologs thereof. Therapeutic agents include, but are not limited to, antimetabolites (e.g., methotrexate, 6-mercaptopurine, 6-thioguanine, cytarabine, 5-fluorouracil decarbazine), alkylating agents (e.g., mechlorethamine, thioepa chlorambucil, melphalan, carmustine (BSNU) and lomustine (CCNU), cyclothosphamide, busulfan, dibromomannitol, streptozotocin, mitomycin C, and cis-dichlorodiamine platinum (II) (DDP) cisplatin), anthracyclines (e.g., daunorubicin (formerly daunomycin) and doxorubicin), antibiotics (e.g., dactinomycin (formerly actinomycin), bleomycin, mithramycin, and anthramycin (AMC)), and anti-mitotic agents (e.g., vincristine and vinblastine).

The conjugates of the invention can be used for modifying a given biological response, the drug moiety is not to be construed as limited to classical chemical therapeutic agents. For example, the drug moiety may be a protein or polypeptide possessing a desired biological activity. Such proteins may include, for example, a toxin such as abrin, ricin A, pseudomonas exotoxin, or diphtheria toxin; a protein such as tumor necrosis factor, .alpha.-interferon, .beta.-interferon, nerve growth factor, platelet derived growth factor, tissue plasminogen activator; or, biological response modifiers such as, for example, lymphokines, interleukin-1 ("IL-1"), interleukin-2 ("IL-2"), interleukin-6 ("IL-6"), granulocyte macrophase colony stimulating factor ("GM-CSF"), granulocyte colony stimulating factor ("G-CSF"), or other growth factors.

Techniques for conjugating such therapeutic moiety to antibodies are well known, see, e.g., Arnon et al., "Monoclonal Antibodies For Immunotargeting Of Drugs In Cancer Therapy", in Monoclonal Antibodies And Cancer Therapy, Reisfeld et al. (eds.), pp. 243-56 (Alan R. Liss, Inc. 1985); Hellstrom et al., "Antibodies For Drug Delivery", in Controlled Drug Delivery (2nd Ed.), Robinson et al. (eds.), pp. 623-53 (Marcel Dekker, Inc. 1987); Thorpe, "Antibody Carriers Of Cytotoxic Agents In Cancer Therapy: A Review", in Monoclonal Antibodies '84: Biological And Clinical Applications, Pinchera et al. (eds.), pp. 475-506 (1985); "Analysis, Results, And Future Prospective Of The Therapeutic Use Of Radiolabeled Antibody In Cancer Therapy", in Monoclonal Antibodies For Cancer Detection And Therapy, Baldwin et al. (eds.), pp. 303-16 (Academic Press 1985), and Thorpe et al., "The Preparation And Cytotoxic Properties Of Antibody-Toxin Conjugates", immunol. Rev., 62:119-58 (1982).

Alternatively, an antibody can be conjugated to a second antibody to form an antibody heteroconjugate as described by Segal in U.S. Pat. No. 4,676,980, incorporated herein by reference in its entirety.

Accordingly, in one aspect, the invention provides substantially purified antibodies or fragment thereof, and human and non-human antibodies or fragments thereof, which antibodies or fragments specifically bind to a polypeptide comprising an amino acid sequence selected from the group consisting of: the amino acid sequence of any one of SEQ ID NOs: 2, 25, 28, 30, 32, 34, 36, 38, 40, 42, 44 or 46, or an amino acid sequence encoded by the cDNA of a clone deposited as ATCC® 98348; a fragment of at least 15 amino acid residues of the amino acid sequence of any one of SEQ ID NOs: 2, 25, 28, 30, 32, 34, 36, 38, 40, 42, 44 or 46, an amino acid sequence which is at least 95% identical to the amino acid sequence of any one of SEQ ID NOs: 2, 25, 28, 30, 32, 34, 36, 38, 40, 42, 44 or 46, wherein the percent identity is determined using the ALIGN program of the GCG software package with a PAM120 weight residue table, a gap length penalty of 12, and a gap penalty of 4; and an amino acid sequence which is encoded by a nucleic acid molecule which hybridizes to the nucleic acid molecule consisting of any one of SEQ ID Nos: 1, 3, 24, 26, 27, 29, 31, 33, 35, 37, 39, 41, 43 or 45, or the cDNA of a clone deposited as ATCC® 98348, or a complement thereof, under conditions of hybridization of 6×SSC at 45° C. and washing in 0.2×SSC, 0.1% SDS at 65° C. In various embodiments, the substantially purified antibodies of the invention, or fragments thereof, can be human, non-human, chimeric and/or humanized antibodies.

In another aspect, the invention provides human and non-human antibodies or fragments thereof, which antibodies or fragments specifically bind to a polypeptide comprising an amino acid sequence selected from the group consisting of: the amino acid sequence of any one of SEQ ID NOs: 2, 25, 28, 30, 32, 34, 36, 38, 40, 42, 44 or 46, or an amino acid sequence encoded by the cDNA of a clone deposited as ATCC® 98348; a fragment of at least 15 amino acid residues of the amino acid sequence of any one of SEQ ID NOs: 2, 25, 28, 30, 32, 34, 36, 38, 40, 42, 44 or 46, an amino acid sequence which is at least 95% identical to the amino acid sequence of any one of SEQ ID NOs: 2, 25, 28, 30, 32, 34, 36, 38, 40, 42, 44 or 46, wherein the percent identity is determined using the ALIGN program of the GCG software package with a PAM 120 weight residue table, a gap length penalty of 12, and a gap penalty of 4; and an amino acid sequence which is encoded by a nucleic acid molecule which hybridizes to the nucleic acid molecule consisting of any one of SEQ ID Nos: 1, 3, 24, 26, 27, 29, 31, 33, 35, 37, 39, 41, 43 or 45, or the cDNA of a clone deposited as ATCC® 98348, or a complement thereof, under conditions of hybridization of 6×SSC at 45° C. and washing in 0.2×SSC, 0.1% SDS at 65° C. Such non-human antibodies can be goat, mouse, sheep, horse, chicken, rabbit, or rat antibodies. Alternatively, the non-human antibodies of the invention can be chimeric and/or humanized antibodies. In addition, the non-human antibodies of the invention can be polyclonal antibodies or monoclonal antibodies.

In still a further aspect, the invention provides monoclonal antibodies or fragments thereof, which antibodies or fragments specifically bind to a polypeptide comprising an amino acid sequence selected from the group consisting of: the amino acid sequence of any one of SEQ ID NOs: 2, 25, 28, 30, 32, 34, 36, 38, 40, 42, 44 or 46, or an amino acid sequence encoded by the cDNA of a clone deposited as ATCC® 98348; a fragment of at least 15 amino acid residues of the amino acid sequence of any one of SEQ ID NOs: 2, 25, 28, 30, 32, 34, 36, 38, 40, 42, 44 or 46, an amino acid sequence which is at least 95% identical to the amino acid sequence of any one of SEQ ID NOs: 2, 25, 28, 30, 32, 34, 36, 38, 40, 42, 44 or 46, wherein the percent identity is determined using the ALIGN program of the GCG software package with a PAM 120 weight residue table, a gap length penalty of 12, and a gap penalty of 4; and an amino acid sequence which is encoded by a nucleic acid molecule which hybridizes to the nucleic acid molecule consisting of any one of SEQ ID NOs: 1, 3, 24, 26, 27, 29, 31, 33, 35, 37, 39, 41, 43 or 45, or the cDNA of a clone deposited as any of ATCC® 98348, or a complement thereof, under conditions of hybridization of 6×SSC at 45° C. and washing in 0.2×SSC, 0.1% SDS at 65° C. The monoclonal antibodies can be human, humanized, chimeric and/or non-human antibodies.

The substantially purified antibodies or fragments thereof specifically bind to a signal peptide, a secreted sequence, an extracellular domain, a transmembrane or a cytoplasmic domain cytoplasmic membrane of a polypeptide of the invention. In a particularly preferred embodiment, the substantially purified antibodies or fragments thereof, the human and non-human antibodies or fragments thereof, and/or the monoclonal antibodies or fragments thereof, of the invention specifically bind to a secreted sequence or an extracellular domain of the amino acid sequence of SEQ ID NOs: 2, 25, 28, 30, 32, 34, 36, 38, 40, 42, 44 or 46. Preferably, the secreted sequence or extracellular domain to which the antibody, or fragment thereof, binds comprises from about amino acids 1-529 or 18-529 of SEQ ID NO: 2, or from amino acids 1-530 or 18-530 of SEQ ID NO: 25.

Any of the antibodies of the invention can be conjugated to a therapeutic moiety or to a detectable substance. Non-limiting examples of detectable substances that can be conjugated to the antibodies of the invention are an enzyme, a prosthetic group, a fluorescent material, a luminescent material, a bioluminescent material, and a radioactive material.

The invention also provides a kit containing an antibody of the invention, and instructions for use. In another embodiment, a kit comprising an antibody of the invention conjugated to a detectable substance and instructions for use. Still another aspect of the invention is a pharmaceutical composition comprising an antibody of the invention and a pharmaceutically acceptable carrier. In preferred embodiments, the pharmaceutical composition contains an antibody of the invention, a therapeutic moiety, and a pharmaceutically acceptable carrier.

Still another aspect of the invention is a method of making an antibody that binds, that is, is directed against, Delta3, the method comprising immunizing a mammal with a polypeptide. The polypeptide used as an immunogen comprises an amino acid sequence selected from the group consisting of: the amino acid sequence of any one of SEQ ID NOs: 2, 25, 28, 30, 32, 34, 36, 38, 40, 42, 44 or 46, or an amino acid sequence encoded by the cDNA of a clone deposited as ATCC® 98348; a fragment of at least 15 amino acid residues of the amino acid sequence of any one of SEQ ID NOs: 2, 25, 28, 30, 32, 34, 36, 38, 40, 42, 44 or 46, an amino acid sequence which is at least 95% identical to the amino acid sequence of any one of SEQ ID NOs: 2, 25, 28, 30, 32, 34, 36, 38, 40, 42, 44 or 46, wherein the percent identity is determined using the ALIGN program of the GCG software package with a PAM120 weight residue table, a gap length penalty of 12, and a gap penalty of 4; and an amino acid sequence which is encoded by a nucleic acid molecule which hybridizes to the nucleic acid molecule consisting of any one of SEQ ID NOs: 1, 3, 24, 26, 27, 29, 31, 33, 35, 37, 39, 41, 43 or 45, or the cDNA of a clone deposited as ATCC® 98348, or a complement thereof, under conditions of hybridization of 6×SSC at 45° C. and washing in 0.2×SSC, 0.1% SDS at 65° C. After immunization, a sample is collected from the mammal that contains an antibody that specifically recognizes Delta3. Preferably, the polypeptide is recombinantly produced using a non-human host cell. Optionally, the antibodies can be further purified from the sample using techniques well known to those of skill in the art. The method can further comprise producing a monoclonal antibody-producing cell from the cells of the mammal. Optionally, antibodies are collected from the antibody-producing cell.

Isolated FTHMA-070, Tango85, Tango77, SPOIL. NEOKINE, Tango129 or A259 Proteins and Anti-FTHMA-070 or Anti-T85 Antibodies One aspect of the invention pertains to isolated FTHMA-070, Tango85, Tango77, SPOIL, NEOKINE, Tango129 or A259 proteins, and biologically active portions thereof, as well as polypeptide fragments suitable for use as immunogens to raise anti-FTHMA-070, Tango85, Tango77, SPOIL, NEOKINE, Tango129 or A259 antibodies. In one embodiment, native FTHMA-070, Tango85, Tango77, SPOIL, NEOKINE, Tango129 or A259 proteins can be isolated from cells or tissue sources by an appropriate purification scheme using standard protein purification techniques. In another embodiment, FTHMA-070, Tango85, Tango77, SPOIL, NEOKINE, Tango129 or A259 proteins are produced by recombinant DNA techniques. Alternative to recombinant expression, a FTHMA-070, Tango85, Tango77, SPOIL, NEOKINE, Tango129 or A259 protein or polypeptide can be synthesized chemically using standard peptide synthesis techniques.

An "isolated" or "purified" protein or biologically active portion thereof is substantially free of cellular material or other contaminating proteins from the cell or tissue source from which the FTHMA-070, Tango85, Tango77, SPOIL, NEOKINE, Tango129 or A259 protein is derived, or substantially free from chemical precursors or other chemicals when chemically synthesized. The language "substantially free of cellular material" includes preparations of FTHMA-070, Tango85, Tango77, SPOIL, NEOKINE, Tango129 or A259 protein in which the protein is separated from cellular components of the cells from which it is isolated or recombinantly produced. Thus, FTHMA-070, Tango85, Tango77, SPOIL, NEOKINE, Tango129 or A259 protein that is substantially free of cellular material includes preparations of FTHMA-070, Tango85, Tango77, SPOIL, NEOKINE, Tango129 or A259 protein having less than about 30%, 20%, 10%, or 5% (by dry weight) of non-FTHMA-070, Tango85, Tango77, SPOIL, NEOKINE, Tango129 or A259 protein (also referred to herein as a "contaminating protein"). When the FTHMA-070, Tango85, Tango77, SPOIL, NEOKINE, Tango129 or A259 protein or biologically active portion thereof is recombinantly produced, it is also preferably substantially free of culture medium, i.e., culture medium represents less than about 20%, 10%, or 5% of the volume of the protein preparation. When FTHMA-070, Tango85, Tango77, SPOIL, NEOKINE, Tango129 or A259 protein is produced by chemical synthesis, it is preferably substantially free of chemical precursors or other chemicals, i.e., it is separated from chemical precursors or other chemicals which are involved in the synthesis of the protein. Accordingly such preparations of FTHMA-070, Tango85, Tango77, SPOIL, NEOKINE, Tango129 or A259 protein have less than about 30%, 20%, 10%, 5% (by dry weight) of chemical precursors or non-FTHMA-070, Tango85, Tango77, SPOIL, NEOKINE, Tango129 or A259 chemicals.

Biologically active portions of a FTHMA-070, Tango85, Tango77, SPOIL, NEOKINE, Tango129 or A259 protein include peptides comprising amino acid sequences sufficiently identical to or derived from the amino acid sequence of the FTHMA-070, Tango85, Tango77, SPOIL, NEOKINE, Tango129 or A259 protein, which include less amino acids than the full length FTHMA-070, Tango85, Tango77, SPOIL, NEOKINE, Tango129 or A259 proteins, and exhibit at least one activity of a FTHMA-070, Tango85, Tango77, SPOIL, NEOKINE, Tango129 or A259 protein. Typically, biologically active portions comprise a domain or motif with at least one activity of the FTHMA-070, Tango85, Tango77, SPOIL, NEOKINE, Tango129 or A259 protein. A biologically active portion of a FTHMA-070, Tango85, Tango77, SPOIL, NEOKINE, Tango129 or A259 protein can be a polypeptide which is, for example, 10, 25, 50, 100 or more amino acids in length. Preferred biologically active polypeptides include one or more identified structural domains. Preferred biologically active polypeptides include one or more identified T129 structural domains, e.g., TNFR/NGFR cysteine-rich domain (SEQ ID NO:142).

Moreover, other biologically active portions, in which other regions of the protein are deleted, can be prepared by recombinant techniques and evaluated for one or more of the functional activities of a native FTHMA-070 or T85 protein. Preferred FTHMA-070 or T85 protein has the amino acid sequence shown of SEQ ID NO:54 or SEQ ID NO:58, respectively. Other useful FTHMA-070 or T85 proteins are substantially identical to SEQ ID NO:54 or SEQ ID NO:58, respectively and retain the functional activity of the reference protein yet differ in amino acid sequence due to natural allelic variation or mutagenesis.

Accordingly, a useful FTHMA-070 protein is a protein which includes an amino acid sequence at least about 45%, preferably 55%, 65%, 75%, 85%, 95%, or 99% identical to the amino acid sequence of SEQ ID NO:54 and retains the functional activity of the FTHMA-070 protein of SEQ ID NO:54. In a preferred embodiment, the FTHMA-070 protein retains the functional activity of the FTHMA-070 protein of SEQ ID NO:54.

Accordingly, a useful T85 protein is a protein which includes an amino acid sequence at least about 45%, preferably 55%, 65%, 75%, 85%, 95%, or 99% identical to the amino acid sequence of SEQ ID NO:58 and retains the functional activity of the T85 protein of SEQ ID NO:58. In other instances, the T85 protein is a protein having an amino acid sequence 55%, 65%, 75%, 85%, 95%, or 98% identical to one of the T85 fibronectin type III or Ig superfamily domains (SEQ ID NOs:61-67). In a preferred embodiment, the T85 protein retains the functional activity of the T85 protein of SEQ ID NO:58.

Preferred Tango-77 protein has the amino acid sequence shown of SEQ ID NO:72, SEQ ID NO:75, SEQ ID NO:77, SEQ ID NO:79, SEQ ID NO:81, or SEQ ID NO:83. Other useful Tango-77 proteins are substantially identical to SEQ ID NO:72, SEQ ID NO:75, SEQ ID NO:77, SEQ ID NO:79, SEQ ID NO:81, or SEQ ID NO:83 and retain the functional activity of the protein of SEQ ID NO:72, SEQ ID NO:75, SEQ ID NO:77, SEQ ID NO:79, SEQ ID NO:81, or SEQ ID NO:83 yet differ in amino acid sequence due to natural allelic variation or mutagenesis. Accordingly, a useful Tango-77 protein is a protein which includes an amino acid sequence at least about 45%, preferably 55%, 65%, 75%, 85%, 95%, or 99% identical to the amino acid sequence of SEQ ID NO:72, SEQ ID NO:75, SEQ ID NO:77, SEQ ID NO:79, SEQ ID NO:81, or SEQ ID NO:83 and retains the functional activity of the Tango-77 proteins of SEQ ID NO:72, SEQ ID NO:75, SEQ ID NO:77, SEQ ID NO:79, SEQ ID NO:81, or SEQ ID NO:83. In a preferred embodiment, the Tango-77 protein retains a functional activity of the Tango-77 protein of SEQ ID NO:72, SEQ ID NO:75, SEQ ID NO:77, SEQ ID NO:79, SEQ ID NO:81, or SEQ ID NO:83.

In one embodiment, a biologically active portion of a SPOIL protein comprises at least an IL-1 signature domain. In another embodiment, a biologically active portion of a SPOIL protein comprises a SPOIL signature motif. In yet another embodiment, a biologically active portion of a SPOIL protein comprises a SPOIL unique domain. In yet another embodiment, a biologically active portion of a SPOIL protein comprises a SPOIL C-terminal unique domain. In another embodiment, a biologically active portion of a SPOIL protein comprises a signal sequence and/or is secreted. In another embodiment, a biologically active portion of a SPOIL protein lacks a signal sequence and/or is intracellular.

It is to be understood that a preferred biologically active portion of a SPOIL protein of the present invention may contain at least one of the above-identified structural domains. Another preferred biologically active portion of a SPOIL protein may contain at least two of the above-identified structural domains. Another preferred biologically active portion of a SPOIL protein may contain at least three or more of the above-identified structural domains.

Moreover, other biologically active portions, in which other regions of the protein are deleted, can be prepared by recombinant techniques and evaluated for one or more of the functional activities of a native SPOIL protein.

In a preferred embodiment, the SPOIL protein has an amino acid sequence shown in SEQ ID NO:90, SEQ ID NO:102, SEQ ID NO:105, SEQ ID NO:113, the amino acid sequence encoded by the DNA insert of the plasmid deposited with ATCC as Accession Number 98883, or the amino acid sequence encoded by the DNA insert of the plasmid deposited with ATCC as Accession Number 98984. In other embodiments, the SPOIL protein is substantially homologous to SEQ ID NO:90, SEQ ID NO:102, SEQ ID NO:105, SEQ ID NO:113, the amino acid sequence encoded by the DNA insert of the plasmid deposited with ATCC as Accession Number 98883, or the amino acid sequence encoded by the DNA insert of the plasmid deposited with ATCC as Accession Number 98984, and retains the functional activity of the protein of SEQ ID NO:90, SEQ ID NO:102, SEQ ID NO:105, SEQ ID NO:113, the amino acid sequence encoded by the DNA insert of the plasmid deposited with ATCC as Accession Number 98883, or the amino acid sequence encoded by the DNA insert of the plasmid deposited with ATCC as Accession Number 98984, yet differs in amino acid sequence due to natural allelic variation or mutagenesis, as described in detail in subsection I above. Accordingly, in another embodiment, the SPOIL protein is a protein which comprises an amino acid sequence at least about 60-65% identical to the amino acid sequence of SEQ ID NO:90, SEQ ID NO:102, SEQ ID NO:105, SEQ ID NO:113, the amino acid sequence encoded by the DNA insert of the plasmid deposited with ATCC as Accession Number 98883, or the amino acid sequence encoded by the DNA insert of the plasmid deposited with ATCC as Accession Number 98984, and, preferably, retains a functional activity of the SPOIL proteins of SEQ ID NO:90, SEQ ID NO:102, SEQ ID NO:105, SEQ ID NO: 113, the amino acid sequence encoded by the DNA insert of the plasmid deposited with ATCC as Accession Number 98883, or the amino acid sequence encoded by the DNA insert of the plasmid deposited with ATCC as Accession Number 98984. Preferably, the protein is at least about 70-75% identical to SEQ ID NO:90, SEQ ID NO:102, SEQ ID NO:105, SEQ ID NO:113, the amino acid sequence encoded by the DNA insert of the plasmid deposited with ATCC as Accession Number 98883, or the amino acid sequence encoded by the DNA insert of the plasmid deposited with ATCC as Accession Number 98984, more preferably at least about 80-85% identical to SEQ ID NO:90, SEQ ID NO:102, SEQ ID NO:105, SEQ ID NO:113, the amino acid sequence encoded by the DNA insert of the plasmid deposited with ATCC as Accession Number 98883, or the amino acid sequence encoded by the DNA insert of the plasmid deposited with ATCC as Accession Number 98984, even more preferably at least about 90-95% identical to SEQ ID NO:90, SEQ ID NO:102, SEQ ID NO: 105, SEQ ID NO:113, the amino acid sequence encoded by the DNA insert of the plasmid deposited with ATCC as Accession Number 98883, or the amino acid sequence encoded by the DNA insert of the plasmid deposited with ATCC as Accession Number 98984, and most preferably at least about 95% or more identical to SEQ ID NO:90, SEQ ID NO:102, SEQ ID NO:105, SEQ ID NO:113, the amino acid sequence encoded by the DNA insert of the plasmid deposited with ATCC as Accession Number 98883, or the amino acid sequence encoded by the DNA insert of the plasmid deposited with ATCC as Accession Number 98984.

In one embodiment, a biologically active portion of a NEOKINE protein comprises at least a NEOKINE CXC signature motif. In another embodiment, a biologically active portion of a NEOKINE protein comprises at least a signal sequence. In another embodiment, a biologically active portion of a NEOKINE protein comprises a NEOKINE amino acid sequence lacking a signal sequence (e.g., a mature NEOKINE protein).

It is to be understood that a preferred biologically active portion of a NEOKINE protein of the present invention may contain at least one of the above-identified structural domains. A more preferred biologically active portion of a NEOKINE protein may contain at least two of the above-identified structural domains. Moreover, other biologically active portions, in which other regions of the protein are deleted, can be prepared by recombinant techniques and evaluated for one or more of the functional activities of a native NEOKINE protein.

In a preferred embodiment, the NEOKINE protein has an amino acid sequence shown in SEQ ID NO:116, SEQ ID NO:119, SEQ ID NO:122, or SEQ ID NO:125. In other embodiments, the NEOKINE protein is substantially homologous to SEQ ID NO:116, SEQ ID NO:119, SEQ ID NO:122, or SEQ ID NO:125, and retains the functional activity of the protein of SEQ ID NO:116, SEQ ID NO:119, SEQ ID NO:122, or SEQ ID NO:125, yet differs in amino acid sequence due to natural allelic variation or mutagenesis, as described in detail in subsection I above. Accordingly, in another embodiment, the NEOKINE protein is a protein which comprises an amino acid sequence at least about 60% homologous to the amino acid sequence of SEQ ID NO:116, SEQ ID NO:119, SEQ ID NO:122, or SEQ ID NO:125 and retains the functional activity of the NEOKINE proteins of SEQ ID NO:116, SEQ ID NO:119, SEQ ID NO:122, or SEQ ID NO:125, respectively. Preferably, the protein is at least about 70% homologous to SEQ ID NO:116, SEQ ID NO:119, SEQ ID NO:122, or SEQ ID NO:125, more preferably at least about 80% homologous to SEQ ID NO:116, SEQ ID NO:119, SEQ ID NO:122, or SEQ ID NO:125, even more preferably at least about 90% homologous to SEQ ID NO:116, SEQ ID NO:119, SEQ ID NO:122, or SEQ ID NO:125, and most preferably at least about 95% or more homologous to SEQ ID NO:116, SEQ ID NO:119, SEQ ID NO:122, or SEQ ID NO:125.

Preferred T129 protein has the amino acid sequence shown of SEQ ID NO:138. Other useful T129 proteins are substantially identical to SEQ ID NO:138 and retain the functional activity of the protein of SEQ ID NO:138 yet differ in amino acid sequence due to natural allelic variation or mutagenesis. Accordingly, a useful T129 protein is a protein which includes an amino acid sequence at least about 45%, preferably 55%, 65%, 75%, 85%, 95%, or 99% identical to the amino acid sequence of SEQ ID NO:138 and retains the functional activity of the T129 proteins of SEQ ID NO:138. In other instances, the T129 protein is a protein having an amino acid sequence 55%, 65%, 75%, 85%, 95%, or 98% identical to the T129 TNFR/NGFR cysteine rich domain (SEQ ID NO:141). In a preferred embodiment, the T129 protein retains the functional activity of the T129 protein of SEQ ID NO:138.

Preferred polypeptides have the amino acid sequence of SEQ ID NO:147, 148, 165, or 166. Other useful proteins are substantially identical (e.g., at least about 45%, preferably 55%, 65%, 75%, 85%, 95%, or 99%) to any of SEQ ID NO:147, 148, 165, or 166, and retain the functional activity of the protein of the corresponding naturally-occurring protein yet differ in amino acid sequence due to natural allelic variation or mutagenesis.

To determine the percent identity of two amino acid sequences or of two nucleic acids, the sequences are aligned for optimal comparison purposes (e.g., gaps can be introduced in the sequence of a first amino acid or nucleic acid sequence for optimal alignment with a second amino or nucleic acid sequence). The amino acid residues or nucleotides at corresponding amino acid positions or nucleotide positions are then compared.

To determine the percent identity of two amino acid sequences or of two nucleic acids, the sequences are aligned for optimal comparison purposes (e.g., gaps can be introduced in the sequence of a first amino acid or nucleic acid sequence for optimal alignment with a second amino or nucleic acid sequence and non-homologous sequences can be disregarded for comparison purposes). In one embodiment, an alignment is a global alignment, e.g., an overall sequence alignment. In another embodiment, an alignment is a local alignment. In a preferred embodiment, the length of a sequence aligned for comparison purposes is at least 30%, preferably at least 40%, more preferably at least 50%, even more preferably at least 60%, and even more preferably at least 70%, 80%, or 90% of the length of the reference sequence to which it is aligned (e.g., when aligning a second sequence to the SPOIL amino acid sequence of SEQ ID NO:90, at least 29, preferably at least 39, more preferably at least 49, even more preferably at least 59, and even more preferably at least 69, 78 or 88 amino acid residues are aligned). In a particularly preferred embodiment, percent identity is calculated over the entire length of a reference sequence. The amino acid residues or nucleotides at corresponding amino acid positions or nucleotide positions are then compared.

To determine the percent homology of two amino acid sequences or of two nucleic acids, the sequences are aligned for optimal comparison purposes (e.g., gaps can be introduced in the sequence of a first amino acid or nucleic acid sequence for optimal alignment with a second amino or nucleic acid sequence and non-homologous sequences can be disregarded for comparison purposes). In a preferred embodiment, the length of a reference sequence aligned for comparison purposes is at least 30%, preferably at least 40%, more preferably at least 50%, even more preferably at least 60%, and even more preferably at least 70%, 80%, or 90% of the length of the reference sequence (e.g., when aligning a second sequence to the NEOKINE amino acid sequence of SEQ ID NO:2 having 99 amino acid residues, at least 30, preferably at least 40, more preferably at least 50, even more preferably at least 59, and even more preferably at least 69, 79, or 89 are aligned). The amino acid residues or nucleotides at corresponding amino acid positions or nucleotide positions are then compared.

When a position in the first sequence is occupied by the same amino acid residue or nucleotide as the corresponding position in the second sequence, then the molecules are homologous at that position (i.e., as used herein amino acid or nucleic acid "homology" is equivalent to amino acid or nucleic acid "identity"). The percent homology between the two sequences is a function of the number of identical positions shared by the sequences (i.e., % homology=# of identical positions/total # of positions×100).

The determination of percent homology between two sequences can be accomplished using a mathematical algorithm. A preferred, non-limiting example of a mathematical algorithm utilized for the comparison of two sequences is the algorithm of Karlin and Altschul (1990) *Proc. Nat'l Acad. Sci. USA* 87:2264-2268, modified as in Karlin and Altschul (1993) *Proc. Nat'l Acad. Sci. USA* 90:5873-5877. Such an algorithm is incorporated into the NBLAST and XBLAST programs of Altschul, et al. (1990) *J. Mol. Biol.* 215:403-410. BLAST nucleotide searches can be performed with the NBLAST program, score=100, wordlength=12 to obtain nucleotide sequences homologous to FTHMA-070, Tango85, Tango77, SPOIL, NEOKINE, Tango129 or A259 nucleic acid molecules of the invention. BLAST protein searches can be performed with the XBLAST program, score=50, wordlength=3 to obtain amino acid sequences homologous to FTHMA-070, Tango85, Tango77, SPOIL, NEOKINE, Tango129 or A259 protein molecules of the invention. To obtain gapped alignments for comparison purposes, Gapped BLAST can be utilized as described in Altschul et al., (1997) *Nucleic Acids Res.* 25:3389-3402. When utilizing BLAST and Gapped BLAST programs, the default parameters of the respective programs (e.g., XBLAST and NBLAST) can be used. Another preferred, non-limiting example of a mathematical algorithm utilized for the comparison of sequences is the algorithm of Myers and Miller, CABIOS (1989). Such an algorithm is incorporated into the ALIGN program (version 2.0) which is part of the GCG sequence alignment software package. When utilizing the ALIGN program for comparing amino acid sequences, a PAM120 weight residue table, a gap length penalty of 12, and a gap penalty of 4 can be used.

The nucleic acid and protein sequences of the present invention can further be used as a "query sequence" to perform a search against public databases to, for example, identify other family members or related sequences. Such searches can be performed using the NBLAST and XBLAST programs (version 2.0) of Altschul, et al. (1990) *J. Mol. Biol.* 215:403-10. BLAST nucleotide searches can be performed with the NBLAST program, score=100, wordlength=12 to obtain nucleotide sequences homologous to nucleic acid molecules of the invention. BLAST protein searches can be performed with the XBLAST program, score=50, wordlength=3 to obtain amino acid sequences homologous to protein molecules of the invention. To obtain gapped alignments for comparison purposes, Gapped BLAST can be utilized as described in Altschul et al., (1997) *Nucleic Acids Res.* 25(17): 3389-3402. When utilizing BLAST and Gapped BLAST programs, the default parameters of the respective programs (e.g., XBLAST and NBLAST) can be used.

Another preferred, non-limiting example of a mathematical algorithm utilized for the comparison of sequences is the algorithm of Myers and Miller, CABIOS (1989). Such an algorithm is incorporated into the ALIGN program (version 2.0) which is part of the CGC sequence alignment software package. When utilizing the ALIGN program for comparing amino acid sequences, a PAM120 weight residue table, a gap length penalty of 12, and a gap penalty of 4 can be used. Additional algorithms for sequence analysis are known in the art and include ADVANCE and ADAM as described in Torellis and Robotti (1994) *Comput. Appl. Biosci.*, 10:3-5; and FASTA described in Pearson and Lipman (1988) *Proc. Natl. Acad. Sci.* 85:2444-8. Within FASTA, ktup is a control option that sets the sensitivity and speed of the search. If ktup=2, similar regions in the two sequences being compared are found by looking at pairs of aligned residues; if ktup=1, single aligned amino acids are examined. ktup can be set to 2 or 1 for protein sequences, or from 1 to 6 for DNA sequences. The default if ktup is not specified is 2 for proteins and 6 for DNA.

The percent identity between two sequences can be determined using techniques similar to those described above, with or without allowing gaps. In calculating percent identity, only exact matches are counted.

The invention also provides FTHMA-070, Tango85, Tango77, SPOIL, NEOKINE, Tango129 or A259 chimeric or fusion proteins. As used herein, a FTHMA-070, Tango85, Tango77, SPOIL, NEOKINE, Tango129 or A259 "chimeric protein" or "fusion protein" comprises a FTHMA-070, Tango85, Tango77, SPOIL, NEOKINE, Tango129 or A259 polypeptide operatively linked to a non-FTHMA-070, Tango85, Tango77, SPOIL, NEOKINE, Tango129 or A259 polypeptide. A FTMA-070, Tango85, Tango77, SPOIL, NEOKINE, Tango129 or A259 polypeptide refers to a polypeptide having an amino acid sequence corresponding to FTHMA-070, Tango85, Tango77, SPOIL, NEOKINE, Tango129 or A259, whereas a non-FTHMA-070, Tango85, Tango77, SPOIL, NEOKINE, Tango129 or A259 polypeptide refers to a polypeptide having an amino acid sequence corresponding to a protein which is not substantially identical to the FTHMA-070, Tango85, Tango77, SPOIL, NEOKINE, Tango129 or A259 protein, e.g., a protein which is different from the FTHMA-070, Tango85, Tango77, SPOIL, NEOKINE, Tango129 or A259 protein and which is derived from the same or a different organism. Within a FTHMA-070, Tango85, Tango77, SPOIL, NEOKINE, Tango129 or A259 fusion protein the FTHMA-070 or T85 polypeptide can correspond to all or a portion of a FTHMA-070, Tango85, Tango77, SPOIL, NEOKINE, Tango129 or A259 protein, preferably at least one biologically active portion of a FTHMA-070, Tango85, Tango77, SPOIL, NEOKINE, Tango129 or A259 protein. Within the fusion protein, the term "operatively linked" is intended to indicate that the FTHMA-070, Tango85, Tango77, SPOIL, NEOKINE, Tango129 or A259 polypeptide and the non-FTHMA-070 or T85 polypeptide are fused in-frame to each other. The non-FTHMA-070, Tango85, Tango77, SPOIL, NEOKINE, Tango129 or A259 polypeptide can be fused to the N-terminus or C-terminus of the FTHMA-070, Tango85, Tango77, SPOIL, NEOKINE, Tango129 or A259 polypeptide.

One useful fusion protein is a GST-FTHMA-070, Tango85, Tango77, SPOIL, NEOKINE, Tango129 or A259 fusion protein in which the FTHMA-070, Tango85, Tango77, SPOIL, NEOKINE, Tango129 or A259 sequences are fused to the C-terminus of the GST sequences. Such fusion proteins can facilitate the purification of recombinant FTHMA-070, Tango85, Tango77, SPOIL, NEOKINE, Tango129 or A259.

In another embodiment, the fusion protein is a FTHMA-070, Tango85, SPOIL, or NEOKINE protein containing a heterologous signal sequence at its N-terminus. For example, the native FTHMA-070, Tango85, SPOIL, or NEOKINE signal sequence can be removed and replaced with a signal sequence from another protein. In certain host cells (e.g., mammalian host cells), expression and/or secretion of FTHMA-070, Tango85, SPOIL, or NEOKINE can be increased through use of a heterologous signal sequence.

In another embodiment, the fusion protein is a Tango-77, Tango129 or A259 protein containing a heterologous signal sequence at its N-terminus. For example, the native Tango-77, Tango129 or A259 signal sequence (i.e., about amino acids 1 to 63 of SEQ ID NO:72; SEQ ID NO:74; or about amino acids 1 to 52 of SEQ ID NO:77; SEQ ID NO:78; or about amino acids 1 to 21 of SEQ ID NO:81; SEQ ID NO:82) can be removed and replaced with a signal sequence from another protein. For example, the native T129 signal sequence (i.e., about amino acids 1 to 22 of SEQ ID NO: 138) can be removed and replaced with a signal sequence from another protein. In certain host cells (e.g., mammalian host cells), expression and/or secretion of Tango-77 can be increased through use of a heterologous signal sequence. For example, the gp67 secretory sequence of the baculovirus envelope protein can be used as a heterologous signal sequence (Ausubel et al., supra). Other examples of eukaryotic heterologous signal sequences include the secretory sequences of melittin and human placental alkaline phosphatase (Stratagene; La Jolla, Calif.). In yet another example, useful prokaryotic heterologous signal sequences include the phoA secretory signal (Sambrook et al., supra) and the protein A secretory signal (Pharmacia Biotech; Piscataway, N.J.).

In yet another embodiment, the fusion protein is an FTHMA-070, Tango85, Tango77, Tango129 or A259-immunoglobulin fusion protein in which all or part of FTHMA-070 or T85 is fused to sequences derived from a member of the immunoglobulin protein family. The FTHMA-070, Tango85, Tango77, Tango129 or A259-immunoglobulin fusion proteins of the invention can be incorporated into pharmaceutical compositions and administered to a subject to inhibit an interaction between a FTHMA-070, Tango85, Tango77, Tango129 or A259 ligand and a FTHMA-070, Tango85, Tango77, Tango129 or A259 protein. The FTHMA-070, Tango85, Tango77, Tango129 or A259-immunoglobulin fusion proteins can be used to affect the bioavailability of a FTHMA-070, Tango85, Tango77, Tango129 or A259 cognate ligand. Inhibition of the FTHMA-070, Tango85, Tango77, Tango129 or A259 ligand/FTHMA-070, Tango85, Tango77, Tango129 or A259 interaction may be useful therapeutically. Moreover, the FTHMA-070, Tango85, Tango77, Tango 129 or A259-immunoglobulin fusion proteins of the invention can be used as immunogens to produce anti-FTHMA-070, Tango85, Tango77, Tango129 or A259 antibodies in a subject, to purify FTHMA-070, Tango85, Tango77, Tango129 or A259 ligands and in screening assays to identify molecules which inhibit the interaction of FTHMA-070, Tango85, Tango77, Tango129 or A259 with a FTHMA-070, Tango85, Tango77, Tango129 or A259 ligand.

In yet another embodiment, the fusion protein is a SPOIL or NEOKINE-immunoglobulin fusion protein in which the SPOIL or NEOKINE sequence are fused to sequences derived from a member of the immunoglobulin protein family. Soluble derivatives have also been made of cell surface glycoproteins in the immunoglobulin gene superfamily consisting of an extracellular domain of the cell surface glycoprotein fused to an immunoglobulin constant (Fc) region (see e.g., Capon et al. (1989) Nature 337:525-531 and Capon U.S. Pat. Nos. 5,116,964 and 5,428,130 [CD4-IgG1 constructs]; Linsley, et al. (1991) J. Exp. Med. 173:721-730 [a CD28-IgG1 construct and a B7-1-IgG1 construct]; and Linsley et al. (1991) J. Exp. Med. 174:561-569 and U.S. Pat. No. 5,434,131 [a CTLA4-IgG1]). Such fusion proteins have proven useful for modulating receptor-ligand interactions. Soluble derivatives of cell surface proteins of the tumor necrosis factor receptor (TNFR) superfamily proteins have been made consisting of an extracellular domain of the cell surface receptor fused to an immunoglobulin constant (Fc) region (See for example Moreland et al. (1997) N. Engl. J. Med. 337(3):141-147; van der Poll et al. (1997) Blood 89(10):3727-3734; and Ammann et al. (1997) J. Clin. Invest. 99(7):1699-1703.).

In yet another embodiment, the fusion protein comprises NEOKINE sequences (e.g., the NEOKINE CXC signature motif) fused to sequences form other CXC cytokines. For example, NEOKINE sequences C-terminal to and including the first conserved cysteine residues can be fused to N-terminal sequences of other non-NEOKINE chemokines (e.g., comprising from the N-terminal amino acid residue to the amino acid residue N-terminal to the first conserved cysteine).

The SPOIL or NEOKINE-immunoglobulin fusion proteins of the invention can be incorporated into pharmaceutical compositions and administered to a subject to inhibit an interaction between a SPOIL or NEOKINE protein and a SPOIL or NEOKINE target molecule on the surface of a cell, to thereby suppress SPOIL or NEOKINE-mediated signal transduction in vivo. The SPOIL or NEOKINE-immunoglobulin fusion proteins can be used to affect the bioavailability of a SPOIL or NEOKINE cognate ligand. Inhibition of the SPOIL or NEOKINE ligand/SPOIL or NEOKINE interaction may be useful therapeutically for both the treatment and modulation of inflammation and immune disorders, as well as modulating (e.g., promoting or inhibiting) immune cell responses, cell adhesion, and/or cell homing. Moreover, the SPOIL or NEOKINE-immunoglobulin fusion proteins of the invention can be used as immunogens to produce anti-SPOIL or NEOKINE antibodies in a subject, to purify SPOIL or NEOKINE ligands and in screening assays to identify molecules which inhibit the interaction of SPOIL or NEOKINE with a SPOIL or NEOKINE target molecule.

Preferably, a FTHMA-070, Tango85, Tango77, SPOIL, NEOKINE, Tango129 or A259 chimeric or fusion protein of the invention is produced by standard recombinant DNA techniques. For example, DNA fragments coding for the different polypeptide sequences are ligated together in-frame in accordance with conventional techniques, for example by employing blunt-ended or stagger-ended termini for ligation, restriction enzyme digestion to provide for appropriate termini, filling-in of cohesive ends as appropriate, alkaline phosphatase treatment to avoid undesirable joining, and enzymatic ligation. In another embodiment, the fusion gene can be synthesized by conventional techniques including automated DNA synthesizers. Alternatively, PCR amplification of gene fragments can be carried out using anchor primers which give rise to complementary overhangs between two consecutive gene fragments which can subsequently be annealed and reamplified to generate a chimeric gene sequence (see, e.g., *Current Protocols in Molecular Biology*, Ausubel et al. eds., John Wiley & Sons: 1992). Moreover, many expression vectors are commercially available that already encode a fusion moiety (e.g., a GST polypeptide). An FTHMA-070, Tango85, Tango77, SPOIL, NEOKINE, Tango129 or A259-encoding nucleic acid can be cloned into such an expression vector such that the fusion moiety is linked in-frame to the FTHMA-070, Tango85, Tango77, SPOIL, NEOKINE, Tango129 or A259 protein.

A signal sequence of a polypeptide of the invention (SEQ ID NO:149 and 163) can be used to facilitate secretion and isolation of the secreted protein or other proteins of interest. Signal sequences are typically characterized by a core of hydrophobic amino acids which are generally cleaved from the mature protein during secretion in one or more cleavage events. Such signal peptides contain processing sites that allow cleavage of the signal sequence from the mature proteins as they pass through the secretory pathway. Thus, the invention pertains to the described polypeptides having a signal sequence, as well as to the signal sequence itself and to the polypeptide in the absence of the signal sequence (i.e., the cleavage products). In one embodiment, a nucleic acid sequence encoding a signal sequence of the invention can be operably linked in an expression vector to a protein of interest, such as a protein which is ordinarily not secreted or is otherwise difficult to isolate. The signal sequence directs secretion of the protein, such as from a eukaryotic host into which the expression vector is transformed, and the signal sequence is subsequently or concurrently cleaved. The protein can then be readily purified from the extracellular medium by art recognized methods. Alternatively, the signal sequence can be linked to the protein of interest using a sequence which facilitates purification, such as with a GST domain.

In another embodiment, the signal sequences of the present invention can be used to identify regulatory sequences, e.g., promoters, enhancers, repressors. Since signal sequences are the most amino-terminal sequences of a peptide, it is expected that the nucleic acids which flank the signal sequence on its amino-terminal side will be regulatory sequences which affect transcription. Thus, a nucleotide sequence which encodes all or a portion of a signal sequence can be used as a probe to identify and isolate signal sequences and their flanking regions, and these flanking regions can be studied to identify regulatory elements therein.

The present invention also pertains to variants of the FTHMA-070, Tango85, Tango77, SPOIL, NEOKINE, Tango129 or A259 proteins which function as either FTHMA-070, Tango85, Tango77, SPOIL, NEOKINE, Tango129 or A259 agonists (mimetics) or as FTHMA-070, Tango85, Tango77, SPOIL, NEOKINE, Tango129 or A259 antagonists. Variants of the FTHMA-070, Tango85, Tango77, SPOIL, NEOKINE, Tango129 or A259 protein can be generated by mutagenesis, e.g., discrete point mutation or truncation of the FTHMA-070, Tango85, Tango77, SPOIL, NEOKINE, Tango129 or A259 protein. An agonist of the FTHMA-070, Tango85, Tango77, SPOIL, NEOKINE, Tango129 or A259 protein can retain substantially the same, or a subset, of the biological activities of the naturally occurring form of the FTHMA-070, Tango85, Tango77, SPOIL, NEOKINE, Tango129 or A259 protein. An antagonist of the FTHMA-070, Tango85, Tango77, SPOIL, NEOKINE, Tango 129 or A259 protein can inhibit one or more of the activities of the naturally occurring form of the FTHMA-070, Tango85, Tango77, SPOIL, NEOKINE, Tango129 or A259 protein by, for example, competitively binding to a downstream or upstream member of a cellular signaling cascade which includes the FTHMA-070, Tango85, Tango77, SPOIL, NEOKINE, Tango129 or A259 protein. Thus, specific biological effects can be elicited by treatment with a variant of limited function. Treatment of a subject with a variant having a subset of the biological activities of the naturally occurring form of the protein can have fewer side effects in a subject relative to treatment with the naturally occurring form of the FTHMA-070, Tango85, Tango77, SPOIL, NEOKINE, Tango129 or A259 proteins.

In one embodiment, a SPOIL protein which acts as an IL-1 receptor antagonist can be converted into an IL-1 agonist by site specific mutagenesis. For example, the aspartic acid at amino acid residue 91 of SEQ ID NO:90 or amino acid residue 74 of SEQ ID NO:93, can be substituted with a lysine to create an IL-1 agonist. In a similar manner, the alanine at amino acid residue 162 of SEQ ID NO:102 or the alanine residue at amino acid residue 201 of SEQ ID NO:105 can be substituted with a lysine to create an IL-1 agonist. Exemplary methods of converting IL-1ra into an IL-1 agonist are set forth in Ju et al. (1991) *Proc. Natl. Acad. Sci. USA* 88:2658-2662.

Variants of the FTHMA-070, Tango85, Tango77, SPOIL, NEOKINE, Tango129 or A259 protein which function as either FTHMA-070, Tango85, Tango77, SPOIL, NEOKINE, Tango129 or A259 agonists (mimetics) or as FTHMA-070, Tango85, Tango77, SPOIL, NEOKINE, Tango129 or A259 antagonists can be identified by screening combinatorial libraries of mutants, e.g., truncation mutants, of the FTHMA-070, Tango85, Tango77, SPOIL, NEOKINE, Tango129 or A259 protein for FTHMA-070, Tango85, Tango77, SPOIL, NEOKINE, Tango129 or A259 protein agonist or antagonist activity. In one embodiment, a variegated library of FTHMA-070, Tango85, Tango77, SPOIL, NEOKINE, Tango129 or A259 variants is generated by combinatorial mutagenesis at the nucleic acid level and is encoded by a variegated gene library. A variegated library of FTHMA-070, Tango85, Tango77, SPOIL, NEOKINE, Tango129 or A259 variants can be produced by, for example, enzymatically ligating a mixture of synthetic oligonucleotides into gene sequences such that a degenerate set of potential FTHMA-070, Tango85, Tango77, SPOIL, NEOKINE, Tango129 or A259 sequences is expressible as individual polypeptides, or alternatively, as a set of larger fusion proteins (e.g., for phage display) containing the set of FTHMA-070, Tango85, Tango77, SPOIL, NEOKINE, Tango129 or A259 sequences therein. There are a variety of methods which can be used to produce libraries of potential FTHMA-070, Tango85, Tango77, SPOIL, NEOKINE, Tango129 or A259 variants from a degenerate oligonucleotide sequence. Chemical synthesis of a degenerate gene sequence can be performed in an automatic DNA synthesizer, and the synthetic gene then ligated into an appropriate expression vector. Use of a degenerate set of genes allows for the provision, in one mixture, of all of the sequences encoding the desired set of potential FTHMA-070, Tango85, Tango77, SPOIL, NEOKINE, Tango129 or A259 sequences. Methods for synthesizing degenerate oligonucleotides are known in the art (see, e.g., Narang (1983) *Tetrahedron* 39:3; Itakura et al. (1984) Annu. Rev. Biochem. 53:323; Itakura et al. (1984) *Science* 198:1056; Ike et al. (1983) *Nucleic Acid Res.* 11:477).

In addition, libraries of fragments of the FTHMA-070, Tango85, Tango77, SPOIL, NEOKINE, Tango129 or A259 protein coding sequence can be used to generate a variegated population of FTHMA-070, Tango85, Tango77, SPOIL, NEOKINE, Tango129 or A259 fragments for screening and subsequent selection of variants of a FTHMA-070, Tango85, Tango77, SPOIL, NEOKINE, Tango129 or A259 protein. In one embodiment, a library of coding sequence fragments can be generated by treating a double stranded PCR fragment of a FTHMA-070, Tango85, Tango77, SPOIL, NEOKINE, Tango129 or A259 coding sequence with a nuclease under conditions wherein nicking occurs only about once per molecule, denaturing the double stranded DNA, renaturing the DNA to form double stranded DNA which can include sense/ antisense pairs from different nicked products, removing single stranded portions from reformed duplexes by treatment with S1 nuclease, and ligating the resulting fragment library into an expression vector. By this method, an expression library can be derived which encodes N-terminal and internal fragments of various sizes of the FTHMA-070, Tango85, Tango77, SPOIL, NEOKINE, Tango129 or A259 protein.

Several techniques are known in the art for screening gene products of combinatorial libraries made by point mutations or truncation, and for screening cDNA libraries for gene products having a selected property. Such techniques are adaptable for rapid screening of the gene libraries generated by the combinatorial mutagenesis of FTHMA-070, Tango85, Tango77, SPOIL, NEOKINE, Tango129, or A259 proteins. The most widely used techniques, which are amenable to high through-put analysis, for screening large gene libraries typically include cloning the gene library into replicable expression vectors, transforming appropriate cells with the resulting library of vectors, and expressing the combinatorial genes under conditions in which detection of a desired activity facilitates isolation of the vector encoding the gene whose product was detected. Recursive ensemble mutagenesis (REM), a technique which enhances the frequency of functional mutants in the libraries, can be used in combination with the screening assays to identify FTHMA-070, Tango85, Tango77, SPOIL, NEOKINE, Tango129 or A259 variants (Arkin and Yourvan (1992) *Proc. Natl. Acad. Sci. USA* 89:7811-7815; Delgrave et al. (1993) *Protein Engineering* 6(3):327-331).

In one embodiment, cell based assays can be exploited to analyze a variegated SPOIL library. For example, a library of expression vectors can be transfected into a cell line which ordinarily responds to a particular ligand in a SPOIL-dependent manner. The transfected cells are then contacted with the ligand and the effect of expression of the mutant on signaling by the ligand can be detected, e.g., by measuring any of a number of immune cell responses. Plasmid DNA can then be recovered from the cells which score for inhibition, or alternatively, potentiation of ligand induction, and the individual clones further characterized.

In one embodiment, cell based assays can be exploited to analyze a variegated NEOKINE library. For example, a library of expression vectors can be transfected into a cell line which ordinarily responds to a particular ligand in a NEOKINE-dependent manner. The transfected cells are then contacted with the ligand and the effect of expression of the mutant on signaling by the ligand can be detected, e.g., by measuring any of a number of inflammatory or angiogenic responses. Plasmid DNA can then be recovered from the cells which score for inhibition, or alternatively, potentiation of ligand induction, and the individual clones further characterized.

An isolated FTHMA-070, Tango85, Tango77, SPOIL, NEOKINE, Tango129 or A259 protein, or a portion or fragment thereof, can be used as an immunogen to generate antibodies that bind FTHMA-070, Tango85, Tango77, SPOIL, NEOKINE, Tango129 or A259 using standard techniques for polyclonal and monoclonal antibody preparation. The full-length FTHMA-070, Tango85, Tango77, SPOIL, NEOKINE, Tango129 or A259 protein can be used or, alternatively, the invention provides antigenic peptide fragments of FTHMA-070, Tango85, Tango77, SPOIL, NEOKINE, Tango129 or A259 for use as immunogens.

The antigenic peptide of FTHMA-070 or T85 comprises at least 8 (preferably 10, 15, 20, or 30) amino acid residues of the amino acid sequence shown in SEQ ID NO:54 and encompasses an epitope of FTHMA-070 or T85 such that an antibody raised against the peptide forms a specific immune complex with FTHMA-070 or T85. Preferred epitopes encompassed by the antigenic peptide are regions of FTHMA-070 or T85 that are located on the surface of the protein, e.g., hydrophilic regions.

The antigenic peptide of Tango-77 comprises at least 8 (preferably 10, 15, 20, or 30) amino acid residues of the amino acid sequence shown in SEQ ID NO:72, SEQ ID NO:75, SEQ ID NO:77, SEQ ID NO:79, SEQ ID NO:81 or SEQ ID NO:83 and encompasses an epitope of Tango-77 such that an antibody raised against the peptide forms a specific immune complex with Tango-77.

The antigenic peptide of SPOIL comprises at least 8 amino acid residues of the amino acid sequence shown in SEQ ID NO:90, SEQ ID NO:102, SEQ ID NO:105, SEQ ID NO:113, the amino acid sequence encoded by the DNA insert of the plasmid deposited with ATCC as Accession Number 98883, or the amino acid sequence encoded by the DNA insert of the plasmid deposited with ATCC as Accession Number 98984, and encompasses an epitope of SPOIL such that an antibody raised against the peptide forms a specific immune complex with SPOIL. Preferably, the antigenic peptide comprises at least 10 amino acid residues, more preferably at least 15 amino acid residues, even more preferably at least 20 amino acid residues, and most preferably at least 30 amino acid residues.

The antigenic peptide of NEOKINE comprises at least 8 amino acid residues of the amino acid sequence shown in SEQ ID NO:116, SEQ ID NO:119, SEQ ID NO:122, or SEQ ID NO:125 and encompasses an epitope of NEOKINE such that an antibody raised against the peptide forms a specific immune complex with NEOKINE. Preferably, the antigenic peptide comprises at least 10 amino acid residues, more preferably at least 15 amino acid residues, even more preferably at least 20 amino acid residues, and most preferably at least 30 amino acid residues. Preferred epitopes encompassed by the antigenic peptide are regions of NEOKINE that are located on the surface of the protein, e.g., hydrophilic regions.

The antigenic peptide of T129 comprises at least 8 (preferably 10, 15, 20, or 30) amino acid residues of the amino acid sequence shown in SEQ ID NO:138 and encompasses an epitope of T129 such that an antibody raised against the peptide forms a specific immune complex with T129.

The antigenic peptide of a259 comprises at least 8 (preferably 10, 15, 20, or 30) amino acid residues of the amino acid sequence of SEQ ID NO:147 or 165, and encompasses an epitope of the protein such that an antibody raised against the peptide forms a specific immune complex with the protein.

Preferred epitopes encompassed by the antigenic peptide are regions of T129 that are located on the surface of the protein, e.g., hydrophilic regions. A hydrophobicity analysis of the human T129 protein sequence indicates that the regions between, e.g., amino acids 120 and 130, between amino acids 140 and 160, and between amino acids 400 and 420 of SEQ ID NO:2 are particularly hydrophilic and, therefore, are likely to encode surface residues useful for targeting antibody production.

A T129 immunogen typically is used to prepare antibodies by immunizing a suitable subject, (e.g., rabbit, goat, mouse or other mammal) with the immunogen. An appropriate immunogenic preparation can contain, for example, recombinantly expressed T129 protein or a chemically synthesized T129 polypeptide. The preparation can further include an adjuvant, such as Freund's complete or incomplete adjuvant, or similar immunostimulatory agent. Immunization of a suitable subject with an immunogenic T129 preparation induces a polyclonal anti-T129 antibody response.

Preferred epitopes encompassed by the antigenic peptide are regions that are located on the surface of the A259 protein, e.g., hydrophilic regions. FIGS. 7 and 8 are hydropathy plots of the proteins of the invention. These plots or similar analyses can be used to identify hydrophilic regions.

A FTHMA-070, Tango85, Tango77, SPOIL, NEOKINE, Tango129 or A259 immunogen typically is used to prepare antibodies by immunizing a suitable subject, (e.g., rabbit, goat, mouse or other mammal) with the immunogen. An appropriate immunogenic preparation can contain, for example, recombinantly expressed FTHMA-070, Tango85, Tango77, SPOIL, NEOKINE, Tango129 or A259 protein or a chemically synthesized FTHMA-070, Tango85, Tango77, SPOIL, NEOKINE, Tango129 or A259 polypeptide. The preparation can further include an adjuvant, such as Freund's complete or incomplete adjuvant, or similar immunostimulatory agent. Immunization of a suitable subject with an immunogenic FTHMA-070, Tango85, Tango77, SPOIL, NEOKINE, Tango129 or A259 preparation induces a polyclonal anti-FTHMA-070, Tango85, Tango77, SPOIL, NEOKINE, Tango129 or A259 antibody response.

Accordingly, another aspect of the invention pertains to anti-FTHMA-070, Tango85, Tango77, SPOIL, NEOKINE, Tango129 or A259 antibodies. The term "antibody" as used herein refers to immunoglobulin molecules and immunologically active portions of immunoglobulin molecules, i.e., molecules that contain an antigen binding site which specifically binds an antigen, such as FTHMA-070, Tango85, Tango77, SPOIL, NEOKINE, Tango129 or A259. A molecule which specifically binds to FTHMA-070, Tango85, Tango77, SPOIL, NEOKINE, Tango129 or A259 is a molecule which binds FTHMA-070, Tango85, Tango77, SPOIL, NEOKINE, Tango129 or A259, but does not substantially bind other molecules in a sample, e.g., a biological sample, which naturally contains FTHMA-070, Tango85, Tango77, SPOIL, NEOKINE, Tango129 or A259. Examples of immunologically active portions of immunoglobulin molecules include F(ab) and F(ab')$_2$ fragments which can be generated by treating the antibody with an enzyme such as pepsin. The invention provides polyclonal and monoclonal antibodies that bind FTHMA-070, Tango85, Tango77, SPOIL, NEOKINE, Tango129 or A259. The term "monoclonal antibody" or "monoclonal antibody composition", as used herein, refers to a population of antibody molecules that contain only one species of an antigen binding site capable of immunoreacting with a particular epitope of FTHMA-070, Tango85, Tango77, SPOIL, NEOKINE, Tango129 or A259. A monoclonal antibody composition thus typically displays a single binding affinity for a particular FTHMA-070, Tango85, Tango77, SPOIL, NEOKINE, Tango129 or A259 protein with which it immunoreacts.

Polyclonal anti-FTHMA-070, Tango85, Tango77, SPOIL, NEOKINE, Tango129 or A259 antibodies can be prepared as described above by immunizing a suitable subject with a FTHMA-070, Tango85, Tango77, SPOIL, NEOKINE, Tango129 or A259 immunogen. The anti-FTHMA-070, Tango85, Tango77, SPOIL, NEOKINE, Tango129 or A259 antibody titer in the immunized subject can be monitored over time by standard techniques, such as with an enzyme linked immunosorbent assay (ELISA) using immobilized FTHMA-070, Tango85, Tango77, SPOIL, NEOKINE, Tango129 or A259. If desired, the antibody molecules directed against FTHMA-070, Tango85, Tango77, SPOIL, NEOKINE, Tango129 or A259 can be isolated from the mammal (e.g., from the blood) and further purified by well-known techniques, such as protein A chromatography to obtain the IgG fraction. At an appropriate time after immunization, e.g., when the anti-FTHMA-070, Tango85, Tango77, SPOIL, NEOKINE, Tango129 or A259 antibody titers are highest, antibody-producing cells can be obtained from the subject and used to prepare monoclonal antibodies by standard techniques, such as the hybridoma technique originally described by Kohler and Milstein (1975) *Nature* 256:495-497, the human B cell hybridoma technique (Kozbor et al. (1983) *Immunol Today* 4:72), the EBV-hybridoma technique (Cole et al. (1985), *Monoclonal Antibodies and Cancer Therapy*, Alan R. Liss, Inc., pp. 77-96) or trioma techniques. The technology for producing various antibodies monoclonal antibody hybridomas is well known (see generally Current Protocols in Immunology (1994) Coligan et al. (eds.) John Wiley & Sons, Inc., New York, N.Y.). Briefly, an immortal cell line (typically a myeloma) is fused to lymphocytes (typically splenocytes) from a mammal immunized with a FTHMA-070, Tango85, Tango77, SPOIL, NEOKINE, Tango129 or A259 immunogen as described above, and the culture supernatants of the resulting hybridoma cells are screened to identify a hybridoma producing a monoclonal antibody that binds FTHMA-070, Tango85, Tango77, SPOIL, NEOKINE, Tango129 or A259.

Any of the many well known protocols used for fusing lymphocytes and immortalized cell lines can be applied for the purpose of generating an anti-FTHMA-070, Tango85, Tango77, SPOIL, NEOKINE, Tango129 or A259 monoclonal antibody (see, e.g., Current Protocols in Immunology, supra; Galfre et al. (1977) *Nature* 266:55052; R. H. Kenneth, in *Monoclonal Antibodies: A New Dimension In Biological Analyses*, Plenum Publishing Corp., New York, N.Y. (1980); and Lerner (1981) *Yale J. Biol. Med.*, 54:387-402. Moreover, the ordinarily skilled worker will appreciate that there are many variations of such methods which also would be useful. Typically, the immortal cell line (e.g., a myeloma cell line) is derived from the same mammalian species as the lymphocytes. For example, murine hybridomas can be made by fusing lymphocytes from a mouse immunized with an immunogenic preparation of the present invention with an immortalized mouse cell line, e.g., a myeloma cell line that is sensitive to culture medium containing hypoxanthine, aminopterin and thymidine ("HAT medium"). Any of a number of myeloma cell lines can be used as a fusion partner according to standard techniques, e.g., the P3-NS1/1-Ag4-1, P3-x63-Ag8.653 or Sp2/O-Ag14 myeloma lines. These myeloma lines are available from ATCC. Typically, HAT-sensitive mouse myeloma cells are fused to mouse splenocytes using polyethylene glycol ("PEG"). Hybridoma cells resulting from the fusion are then selected using HAT medium, which kills unfused and unproductively fused myeloma cells (unfused splenocytes die after several days because they are not transformed). Hybridoma cells producing a monoclonal antibody of the invention are detected by screening the hybridoma culture supernatants for antibodies that bind FTHMA-070, Tango85, Tango77, SPOIL, NEOKINE, Tango129 or A259, e.g., using a standard ELISA assay.

Alternative to preparing monoclonal antibody-secreting hybridomas, a monoclonal anti-FTHMA-070, Tango85, Tango77, SPOIL, NEOKINE, Tango129 or A259 antibody can be identified and isolated by screening a recombinant combinatorial immunoglobulin library (e.g., an antibody phage display library) with FTHMA-070, Tango85, Tango77, SPOIL, NEOKINE, Tango129 or A259 to thereby isolate immunoglobulin library members that bind FTHMA-070, Tango85, Tango77, SPOIL, NEOKINE, Tango129 or A259. Kits for generating and screening phage display libraries are commercially available (e.g., the Pharmacia *Recombinant Phage Antibody System*, Catalog No. 27-9400-01; and the Stratagene SurfZAP™ Phage Display Kit, Catalog No. 240612). Additionally, examples of methods and reagents particularly amenable for use in generating and screening antibody display library can be found in, for example, U.S. Pat. No. 5,223,409; PCT Publication No. WO 92/18619; PCT Publication No. WO 91/17271; PCT Publication WO 92/20791; PCT Publication No. WO 92/15679; PCT Publication WO 93/01288; PCT Publication No. WO 92/01047; PCT Publication No. WO 92/09690; PCT Publication No. WO 90/02809; Fuchs et al. (1991) *Bio/Technology* 9:1370-1372; Hay et al. (1992) *Hum. Antibod. Hybridomas* 3:81-85; Huse et al. (1989) *Science* 246:1275-1281; Griffiths et al. (1993) *EMBO J.* 12:725-734.

Additionally, recombinant anti-FTHMA-070, Tango85, Tango77, SPOIL, NEOKINE, Tango129 or A259 antibodies, such as chimeric and humanized monoclonal antibodies, comprising both human and non-human portions, which can be made using standard recombinant DNA techniques, are within the scope of the invention. Such chimeric and humanized monoclonal antibodies can be produced by recombinant DNA techniques known in the art, for example using methods described in PCT Application No. PCT/US86/02269; European Patent Application 184,187; European Patent Application 171,496; European Patent Application 173,494; PCT Publication No. WO 86/01533; U.S. Pat. No. 4,816,567; European Patent Application 125,023; Better et al. (1988) *Science* 240:1041-1043; Liu et al. (1987) *Proc. Natl. Acad. Sci. USA* 84:3439-3443; Liu et al. (1987) *J. Immunol.* 139:3521-3526; Sun et al. (1987) *Proc. Natl. Acad. Sci. USA* 84:214-218; Nishimura et al. (1987) *Canc. Res.* 47:999-1005; Wood et al. (1985) *Nature* 314:446-449; and Shaw et al. (1988) *J. Natl. Cancer Inst.* 80:1553-1559); Morrison, (1985) *Science* 229:1202-1207; Oi et al. (1986) *Bio/Techniques* 4:214; U.S. Pat. No. 5,225,539; Jones et al. (1986) *Nature* 321:552-525; Verhoeyan et al. (1988) *Science* 239:1534; and Beidler et al. (1988) *J. Immunol.* 141:4053-4060.

Completely human antibodies are particularly desirable for therapeutic treatment of human patients. Such antibodies can be produced using transgenic mice which are incapable of expressing endogenous immunoglobulin heavy and light chains genes, but which can express human heave and light chain genes. The transgenic mice are immunized in the normal fashion with a selected antigen, e.g., all or a portion of Tango-77 or A259. Monoclonal antibodies directed against the antigen can be obtained using conventional hybridoma technology. The human immunoglobulin transgenes harbored by the transgenic mice rearrange during B cell differentiation, and subsequently undergo class switching and somatic mutation. Thus, using such a technique, it is possible to produce therapeutically useful IgG, IgA and IgE antibodies. For an overview of this technology for producing human antibodies, see Lonberg and Huszar (1995, *Int. Rev. Immunol.* 13:65-93). For a detailed discussion of this technology for producing human antibodies and human monoclonal antibodies and protocols for producing such antibodies, see, e.g., U.S. Pat. Nos. 5,625,126; 5,633,425; 5,569,825; 5,661,016; and 5,545,806. In addition, companies such as Abgenix, Inc. (Freemont, Calif.), can be engaged to provide human antibodies directed against a selected antigen using technology similar to the described above.

Completely human antibodies which recognize a selected epitope can be generated using a technique referred to as "guided selection." In this approach a selected non-human monoclonal antibody, e.g., a murine antibody, is used to guide the selection of a completely human antibody recognizing the same epitope.

First, a non-human monoclonal antibody which binds a selected antigen (epitope), e.g., an antibody which inhibits Tango-77 or A259 activity, is identified. The heave chain and the light chain of the non-human antibody are cloned and used to create phage display Fab fragments. For example, the heave chain gene can be cloned into a plasmid vector so that the heavy chain can be secreted from bacteria. The light chain gene can be cloned into a phage coat protein gene so that the light chain can be expressed on the surface of phage. A repertoire (random collection) of human light chains fused to phage is used to infect the bacteria which express the non-human heavy chain. The resulting progeny phage display hybrid antibodies (human light chain/non-human heavy chain). The selected antigen is used in a panning screen to select phage which bind the selected antigen. Several rounds of selection may be required to identify such phage. Next, human light chain genes are isolated from the selected phage which bind the selected antigen. These selected human light chain genes are then used to guide the selection of human heavy chain genes as follows. The selected human light chain genes are inserted into vectors for expression by bacteria. Bacteria expressing the selected human light chains are infected with a repertoire of human heavy chains fused to phage. The resulting progeny phage display human antibodies (human light chain/human heavy chain).

Next, the selected antigen is used in a panning screen to select phage which bind the selected antigen. The phage selected in this step display completely human antibody which recognize the same epitope recognized by the original selected, non-human monoclonal antibody. The genes encoding both the heavy and light chains are readily isolated and be further manipulated for production of human antibody. This technology is described by Jespers et al. (1994, *Bio/technology* 12:899-903).

An anti-FTHMA-070, Tango85, Tango77, SPOIL, NEOKINE, Tango129 or A259 antibody (e.g., monoclonal antibody) can be used to isolate FTHMA-070, Tango85, Tango77, SPOIL, NEOKINE, Tango129 or A259 by standard techniques, such as affinity chromatography or immunoprecipitation. An anti-FTHMA-070, Tango85, Tango77, SPOIL, NEOKINE, Tango129 or A259 antibody can facilitate the purification of natural FTHMA-070, Tango85, Tango77, SPOIL, NEOKINE, Tango129 or A259 from cells and of recombinantly produced FTHMA-070, Tango85, Tango77, SPOIL, NEOKINE, Tango129 or A259 expressed in host cells. Moreover, an anti-FTHMA-070, Tango85, Tango77, SPOIL, NEOKINE, Tango129 or A259 antibody can be used to detect FTHMA-070, Tango85, Tango77, SPOIL, NEOKINE, Tango129 or A259 protein (e.g., in a cellular lysate or cell supernatant) in order to evaluate the abundance and pattern of expression of the FTHMA-070, Tango85, Tango77, SPOIL, NEOKINE, Tango129 or A259 protein. Anti-FTHMA-070, Tango85, Tango77, SPOIL, NEOKINE, Tango129 or A259 antibodies can be used diagnostically to monitor protein levels in tissue as part of a clinical testing procedure, e.g., to, for example, determine the efficacy of a given treatment regimen. Detection can be facilitated by coupling the antibody to a detectable substance. Examples of detectable substances include various enzymes, prosthetic groups, fluorescent materials, luminescent materials, bioluminescent materials, and radioactive materials. Examples of suitable enzymes include horseradish peroxidase, alkaline phosphatase, β-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; examples of bioluminescent materials include luciferase, luciferin, and aequorin, and examples of suitable radioactive material include $^{125}I$, $^{131}I$, $^{35}S$ or $^{3}H$.

Delta3 Methods of Treating Disease

Based at least in part on the fact that the Notch signaling pathway has been implicated in development of the nervous system, in particular in regulating neuronal differentiation and vasculature, e.g., CNS vasculature, a wide variety of pathological diseases or conditions can benefit from treatment with Delta3 nucleic acids, proteins, and modulators thereof. In particular, based at least in part on the observation that PS1 and PS2, genes encoding amyloid precursor proteins, which are mutated in about 10% of cases of Alzheimer's disease, are functionally linked to the Notch signaling pathway, mutations in genes of the Notch signaling pathway, e.g., Delta genes, could also result in Alzheimer's disease or other neurodegenerative or neuro-developmental diseases. The Notch signaling pathway plays a role in the development of vasculature. For example, loss of Dll1 function mutants become severally hemorrhagic after embryonic day 10. Furthermore, mutations in Notch3 result in CADASIL, a disease characterized by stroke. In addition, mice with a functionally ablated PS1 gene exhibit hemorrhages in the brain and/or spinal cord after embryonic day 11.5 (Wong et al. (1997) Nature 387:288). In addition, the Notch pathway has been implicated in hematologic development. Specifically, molecules in the Notch signaling pathway have been shown to be expressed in a wide variety of blood cells, including but not limited to those of myeloid and lymphoid origins. Notch-1 was shown to play a role in T-cell development. Furthermore, since the Notch signaling pathway is involved in cell fate determination at least in the nervous system, immune system and endothelial system, it is likely that the Notch signaling pathway, and in particular Delta3 is involved in cell fate determination in additional biological systems. Accordingly, the invention also provides methods for treating diseases or disorders arising from an abnormal cell proliferation and/or differentiation of cells other than cells from the nervous system, immune system, and vasculature.

Among the disorders that can be treated or prevented according to the methods of the invention include pathological neurogenic, neoplastic or hyperplastic conditions. Neurologic diseases, e.g., neurodegenerative, neuro-differentiative and neuro-developmental diseases, that might benefit from this methodology include, but are not limited to neuropathies, e.g., peripheral neuropathy such as ACCPN, stroke, dementia, e.g., cerebral autosomal dominant arteriopathy with subcortical infarcts and leukoencephalopathy (CADASIL), degenerative lesions (Parkinson's disease, Alzheimer's disease, Huntington's chorea, amyotrophic lateral sclerosis, spinocerebellar degenerations), demyelating diseases (multiple sclerosis, human immunodeficiency associated myelopathy, transverse myelopathy, progressive multi focal leukoencephalopathy, pontine myelinolysis), motor neuron injuries, progressive spinal muscular atrophy, progressive bulbar palsy, primary lateral sclerosis, infantile and juvenile muscular atrophy, progressive bulbar paralysis of childhood (Fazio-Londe syndrome), poliomyelitis, and hereditary motorsensory neuropathy (Charcot-Marie-Tooth disease), spinal cord injuries, brain injuries, lesions associated with surgery, ischemic lesions, malignant lesions, infectious lesions.

Additional neurological diseases that can be treated according to the method of the invention include neuropathies, e.g., peripheral neuropathies, e.g., Agenesis of the Corpus Callosum with Peripheral Neuropathy (ACCPN). In fact, as set forth in the examples presented below, hDelta3 has been mapped to human chromosome 15 close to framework markers D15S1244 and D15S144, a chromosomal region which has been shown to be genetically linked (ACCPN) (Casaubon et al. (1996) Am J. Hum. Genet. 58:28). The disease is characterized by a progressive peripheral neuropathy caused by axonal degeneration and a central nervous system (CNS) malformation characterized by the absence of hypoplasia of the corpus callosum. The disorder appears early in life, is progressive and results in death in the third decade of life of the subject.

Neuropathies refer to disorders of peripheral nerves and includes both motor and sensory functions, since most motor and sensory axons run in the same nerves. Neurophathies may be either chronic or acute. One example of a acute neuropathy is the Guillain-Barre syndrome, which often follow respiratory infection. Chronic neuropathies include, e.g., acute intermittent porphyria, Charcot-Marie-Tooth disease, metabolic diseases such as diabetes, obesity, and B 12 deficiency, intoxication, nutritional disorders.

Disorders of the vasculature, also termed "vascular disorders", in addition to CADASIL and stroke, that can be treated or prevented according to the methods of the invention include atheroma, tumor angiogenesis, wound healing, diabetic retinopathy, hemangioma, psoriasis, and restenosis, e.g., restenosis resulting from balloon angioplasty.

In one embodiment, diseases or disorders caused or contributed to by aberrant Delta3 activity, such as aberrant Delta3 protein levels or an aberrant biological activity or which are associated with one or more specific Delta3 alleles, e.g., a mutant Delta3 allele, can be treated with Delta3 therapeutics. Aberrant protein levels can be caused, e.g., by aberrant gene expression. Such aberrant activity can result, for example, in aberrant cell proliferation and/or differentiation or cell death. For example, aberrant Delta3 activity in a subject can result in increased proliferation of certain cells in the subject. Subjects having a disorder characterized by abnormal cell proliferation can be treated by administration of a Delta3 therapeutic inhibiting or decreasing such proliferation. The specific Delta3 therapeutic used may vary depending on the type of the cell that is proliferating aberrantly. The appropriate Delta3 therapeutic to use can be determined, e.g., by in vitro culture of a sample of such cells which can be obtained from the subject, in the presence and in the absence of Delta3 therapeutics.

Diseases or conditions associated with aberrant cell proliferation which can be treated or prevented with Delta3 therapeutics include cancers, malignant conditions, premalignant conditions, benign conditions. The condition to be treated or prevented can be a solid tumor, such as a tumor arising in an epithelial tissue. For example, the cancer can be colon or cervix cancer. Cancer of the colon and cervix have in fact been found to have increased levels of expression of Notch as compared to normal tissue (PCT Publication No. WO/07474, Apr. 14, 1994). Accordingly, treatment of such a cancer could comprise administration to the subject of a Delta3 therapeutic decreasing the interaction of Notch with Delta3. Other cancers that can be treated or prevented with a Delta3 protein include sarcomas and carcinomas, e.g., lung cancer, cancer of the esophagus, lung cancer, melanoma, seminoma, and squamous adenocarcinoma. Additional solid tumors within the scope of the invention include those that can be found in a medical textbook. The condition to be treated or prevented can also be a soluble tumor, such as leukemia, either chronic or acute, including chronic or acute myelogenous leukemia, chronic or acute lymphocytic leukemia, promyelocytic leukemia, monocytic leukemia, myelomonocytic leukemia, and erythroleukemia. Yet other proliferative disorders that can be treated with a Delta3 therapeutic of the invention include heavy chain disease, multiple myeloma, lymphoma, e.g., Hodgkin's lymphoma and non-Hodgkin's lymphoma, Waldenstroem's macroglobulemia, and fibroproliferative disorders, particularly of cerebravascular tissue.

Diseases or conditions characterized by a solid or soluble tumor can be treated by administrating a Delta3 therapeutic either locally or systemically, such that proliferation of the cells having an aberrant proliferation is inhibited or decreased. Methods for administering the compounds of the invention are further described below.

The invention also provides methods for preventing the formation and/or development of tumors. For example, the development of a tumor can be preceded by the presence of a specific lesion, such as a pre-neoplastic lesion, e.g., hyperplasia, metaplasia, and dysplasia. Such lesions can be found, e.g., in epithelial tissue. Thus, the invention provides a method for inhibiting progression of such a lesion into a neoplastic lesion, comprising administering to the subject having a preneoplastic lesion a amount of a Delta3 therapeutic sufficient to inhibit progression of the preneoplastic lesion into a neoplastic lesion.

In a preferred embodiment, the invention provides a method for inhibiting endothelial cell proliferation and/or differentiation, comprising contacting a Delta3 therapeutic with a tissue in which endothelial cells are proliferating, such as a developing tumor or a hyperproliferative disease, i.e., a disease associated with abnormal cellular proliferation. Blocking the proliferation of endothelial cells will result in inhibition of development of endothelium and blood vessels, thus limiting access to the tumor of compounds necessary for tumor development.

The invention also provides for methods for treating or preventing diseases or conditions associated with insufficient cell proliferation. For example, Delta3 therapeutics can be used to stimulate tissue repair, regeneration, and/or wound healing, e.g., of neural tissue, such as after surgery or to stimulate tissue healing from burns. Other disease in which proliferation of cells is desired are hypoproliferative diseases, i.e., diseases characterized by an abnormally low proliferation of certain cells.

In yet another embodiment, the invention provides a method for treating or preventing diseases or conditions characterized by aberrant cell differentiation. Accordingly, the invention provides methods for stimulating cellular differentiation in conditions characterized by an inhibition of normal cell differentiation which may or may not be accompanied by excessive proliferation. Alternatively, Delta3 therapeutics can be used to inhibit differentiation of specific cells.

In one method, the aberrantly proliferating and/or differentiating cell is a cell present in the nervous system. Accordingly, the invention provides methods for treating diseases or conditions associated with a central or peripheral nervous system. For example, the invention provides methods for treating lesions of the nervous system involving an aberrant Delta3 activity in neurons, in Schwann cells, glial cells, or other types of neural cells. Disorders of the nervous system are set forth above.

In another embodiment, a Delta3 therapeutic can be utilized to ameliorate a symptom of obesity and/or disorders that accompany or are exacerbated by an obese state, such as cardiovascular and circulatory disorders, metabolic abnormalities typical of obesity, such as hyperinsulinemia, insulin resistance, diabetes, including non-insulin dependent diabetes mellitus (NIDDM), insulin dependent diabetes mellitus (IDDM), and maturity onset diabetes of the young (MODY), disorders of energy homeostasis, disorders associated with lipid metabolism, such as cachexia.

With respect to cardiovascular disorders, symptoms of coronary diseases (e.g., cardiovascular diseases including unstable angina pectoris, myocardial infarction, acute myocardial infarction, coronary artery disease, coronary revascularization, coronary restenosis, ventricular thromboembolism, atherosclerosis, coronary artery disease (e.g., arterial occlusive disorders), plaque formation, cardiac ischemia, including complications related to coronary procedures, such as percutaneous coronary artery angioplasty (balloon angioplasty) procedures) can be ameliorated. With respect to coronary procedures, such modulation can be achieved via administration of Delta3 therapeutics prior to, during, or subsequent to the procedure.

Delta3 therapeutics (e.g., nucleic acids, proteins and modulators thereof) can, therefore, be used to modulate disorders resulting from any blood vessel insult that can result in platelet aggregation. Such blood vessel insults include, but are not limited to, vessel wall injury, such as vessel injuries that result in a highly thrombogenic surface exposed within an otherwise intact blood vessel e.g., vessel wall injuries that result in release of ADP, thrombin and/or epinephrine, fluid shear stress that occurs at the site of vessel narrowing, ruptures and/or tears at the sites of atherosclerotic plaques, and injury resulting from balloon angioplasty or atherectomy. Preferably, such therapeutics do not effect initial platelet adhesion to vessel surfaces, or effect such adhesion to a relatively lesser extent than the effect on platelet-platelet aggregation, e.g., unregulated platelet-platelet aggregation, following the initial platelet adhesion.

In addition, Delta3 therapeutics can be utilized to amieliorate a symptom of disorders associated with abnormal vasculogenesis (e.g., cancers, including, but not limited to, cancers of the epithelia (e.g., carcinomas of the pancreas, stomach, liver, secretory glands (e.g., adenocarcinoma), bladder, lung, breast, skin (e.g., fibromatosis or malignant melanoma), reproductive tract including prostate gland, ovary, cervix and uterus); cancers of the hematopoietic and immune system (e.g., leukemias and lymphomas); cancers of the central nervous, brain system and eye (e.g., gliomas, neuroblastoma and retinoblastoma); and cancers of connective tissues, bone, muscles and vasculature (e.g., hemangiomas and sarcomas)), disorders related to fetal development, in particular, disorders involving development of lung and kidney, lung-related disorders, and immune-related disorders, such as inflammatory-related disorders, e.g., asthma, allergy, and autoimmune disorders, as well as neurological disorders, including developmental, cognitive and personality-related disorders, renal disorders, adrenal gland-related disorders; and disorders relating to skeletal muscle, such as dystrophic disorders.

With respect to immune disorders, Delta3 therapeutics (e.g., nucleic acids, proteins and modulators thereof) can be utilized to modulate processes involved in lymphocyte development, differentiation and activity, including, but not limited to development, differentiation and activation of T cells, including T helper, T cytotoxic and non-specific T killer cell types and subtypes, and B cells, immune functions associated with such cells, and amelioration of one or more symptoms associated with abnormal function of such cell types. Such disorders can include, but are not limited to, autoimmune disorders, such as organ specific autoimmune disorders, e.g., autoimmune thyroiditis, Type I diabetes mellitus, insulin-resistant diabetes, autoimmune anemia, multiple sclerosis, and/or systemic autoimmune disorders, e.g., rheumatoid arthritis, lupus or sclerodoma, allergy, including allergic rhinitis and food allergies, asthma, psoriasis, graft rejection, transplantation rejection, graft versus host disease, pathogenic susceptibilities, e.g., susceptibility to certain bacterial or viral pathogens, wound healing and inflammatory reactions.

With respect to skeletal muscle-related disorders, Delta3 therapeutics can be utilized to ameliorate symptoms of disorders including, for example, muscular dystrophy disorders, e.g., Duchenne's muscular dystrophy and X-linked recessive Emery-Dreifuss dystrophy (EDMD), as well as developmental and other disorders that involve skeletal muscle such as, for example, oculofacial-skeletal myorhythmias, sarcoidosis, and malignant hyperthermia susceptibility (MHS).

With respect to lung disorders, Delta3 therapeutics can be utilized, for example, to ameliorate a symptom of such pulmonary disorders, such as atelectasis, pulmonary congestion or edema, chronic obstructive airway disease (e.g., emphysema, chronic bronchitis, bronchial asthma, and bronchiectasis), diffuse interstitial diseases (e.g., sarcoidosis, pneumoconiosis, hypersensitivity pneumonitis, Goodpasture's syndrome, idiopathic pulmonary hemosiderosis, pulmonary alveolar proteinosis, desquamative interstitial pneumonitis, chronic interstitial pneumonia, fibrosing alveolitis, hamman-rich syndrome, pulmonary eosinophilia, diffuse interstitial fibrosis, Wegener's granulomatosis, lymphomatoid granulomatosis, and lipid pneumonia), or tumors (e.g., bronchogenic carcinoma, bronchiolovlveolar carcinoma, bronchial carcinoid, hamartoma, and mesenchymal tumors).

In another embodiment, the invention provides a method for enhancing the survival and/or stimulating proliferation and/or differentiation of cells and tissues in vitro. For example, tissues from a subject can be obtained and grown in vitro in the presence of a Delta3 therapeutic, such that the tissue cells are stimulated to proliferate and/or differentiate. The tissue can then be readministered to the subject.

In another embodiment, as Notch can function to maintain cells in an immature state in vitro, i.e., as stem cells, e.g., the invention provides a method to expand the pool of hematopoietic stem cells through the interaction of Delta3 with Notch, which can be utilized in cases where it is desirable to do so including, but not limited to preparing cells harvested for subsequent bone marrow transplantation. Thus, Delta 3 can be utilized in stem cell preservation, that is, can be utilized to preserve stem cells in an immature, undifferentiated state, and/or preserving the stem cells' pluripotency, differentiation potential and proliferation potential. In one embodiment of such a stem cell preservation method, stem cells are contacted with cells expressing Delta3 and exhibiting Delta3 on their cell surfaces. Such Delta3-expressing cells can be presented, e.g., as stromal cells in culture. In another embodiment, stem cells are contacted with full-length or soluble Delta3 attached to a solid surface, e.g., a culture plate, or microbeads.

In another embodiment, techniques such as that described above for stem cell preservation can be utilized to prevent death of CD4+/CD8+ T cells. Thus, such techniques can be used to repopulate peripheral T cell populations (e.g., as part of a leukemia therapy), or, and alternatively, can be used to produce and screen for an antigen-specific T cell clone.

In another embodiment, the invention can function as a method to determine the fate of T cells in the developing thymus. Antagonists or antagonists of hDelta3 activity can determine whether a T cell will develop the CD4 or CD8 phenotype and thus be useful as a therapeutic agent in immunodeficiency disorders, such as, but not limited to AIDS.

In another embodiment, as the Notch signaling pathway has been shown to be involved in eye development in *Drosophila*, and given the fact that mDelta3 was highly expressed in the developing mouse eye, Delta3 nucleic acids, proteins, and modulators thereof and/or agonists and antagonists can be used as therapeutics in such eye disorders as diabetic retinopathy, characterized by a hyper-proliferation of capillaries in the retina.

Since, in some cases, genes may be upregulated in a disease state and in other cases may be down-regulated, it will be desirable to activate and/or potentiate or suppress and/or down-modulate Delta3 activity depending on the condition to be treated using the techniques compounds and methods described herein. Some genes may be under-expressed in certain disease states. The activity of Delta3 nucleic acids, proteins, and modulators thereof may be in some way impaired, leading to the development of neurodegenerative disease symptoms. Such down-regulation of Delta3 gene expression or decrease in the activity of a Delta3 protein may have a causative or exacerbating effect on the disease state.

Among the approaches which may be used to ameliorate disease symptoms involving the misexpression of a Delta3 gene are, for example, antisense, ribozyme, and triple helix molecules described above. Compounds that compete with Delta3 nucleic acids, proteins, and modulators thereof for binding to upstream or downstream elements in a Delta/Notch signaling cascade will antagonize Delta3 nucleic acids, proteins, and modulators thereof, thereby inducing a therapeutic effect. Examples of suitable compounds include the antagonists or homologs described in detail above. In other instances, the increased expression or activity of Delta3 nucleic acids, proteins, and modulators thereof may be desirable and may be accomplished by, for example the use of Delta3 agonists or mimetics or by gene replacement therapy, as described herein.

Yet other Delta3 therapeutics comprise of a first peptide comprising a Delta3 peptide capable of binding to a receptor, e.g., a Notch receptor, and a second peptide which is cytotoxic. Such therapeutics can be used to specifically target and lyse cells expressing or over-expressing a receptor for Delta3. For example, a fusion protein containing a Delta3 peptide fused to a cytotoxic peptide can be used to eliminate or reduce a tumor over-expressing Notch, e.g., colon and cervix neoplastic tumors. Alternatively, cells expressing or over-expressing Delta3 can be targeted for lysis, by, for example, targeting to the cell an antibody binding specifically to a Delta3 protein linked to a cytotoxic peptide.

Based at least in part on the similarity of protein structure, it is likely that Delta3 nucleic acids, proteins, and modulators thereof can also be used to treat diseases or conditions caused by or contributed by an aberrant activity of a Delta family gene product, e.g., an aberrant Delta1 or Delta2 activity or diseases or disorders which are associated with one or more specific Delta alleles, e.g., Delta1 or Delta2 alleles. Such diseases or conditions could include neurological diseases and cancer. Similarly, Delta therapeutics, e.g., Delta1 or Delta2 therapeutics, could be used to prevent or treat diseases or disorders caused by or contributed to by an aberrant Delta3 activity, or diseases or disorders which are associated with a specific Delta3 allele. Delta therapeutics can be prepared using, e.g., the nucleotide and protein sequence information disclosed in the PCT Patent Publication WO 97/01571 and tested using the assays described herein for testing Delta3 therapeutics.

Compounds identified as increasing or decreasing Delta3 gene expression or protein activity can be administered to a subject at therapeutically effective dose to treat or ameliorate cardiovascular disease. A therapeutically effective dose refers to that amount of the compound sufficient to result in amelioration of symptoms associated with the particular disease.

Pharmaceutical Compositions

The Delta3, FTHMA-070, Tango85, Tango77, SPOIL, NEOKINE, Tango129 or A259 nucleic acid molecules, Delta3, FTHMA-070, Tango85, Tango77, SPOIL, NEOKINE, Tango129 or A259 proteins, and anti-Delta3, FTHMA-070, Tango85, Tango77, SPOIL, NEOKINE, Tango129 or A259 antibodies (also referred to herein as "active compounds") of the invention can be incorporated into pharmaceutical compositions suitable for administration. Such compositions typically comprise the nucleic acid molecule, protein, or antibody and a pharmaceutically acceptable carrier. As used herein the language "pharmaceutically acceptable carrier" is intended to include any and all solvents, dispersion media, coatings, antibacterial and antifungal agents, isotonic and absorption delaying agents, and the like, compatible with pharmaceutical administration. The use of such media and agents for pharmaceutically active substances is well known in the art. Except insofar as any conventional media or agent is incompatible with the active compound, use thereof in the compositions is contemplated. Supplementary active compounds can also be incorporated into the compositions.

The invention includes methods for preparing pharmaceutical compositions for modulating the expression or activity of a polypeptide or nucleic acid of the invention. Such methods comprise formulating a pharmaceutically acceptable carrier with an agent which modulates expression or activity of a polypeptide or nucleic acid of the invention. Such compositions can further include additional active agents. Thus, the invention further includes methods for preparing a pharmaceutical composition by formulating a pharmaceutically acceptable carrier with an agent which modulates expression or activity of a polypeptide or nucleic acid of the invention and one or more additional active compounds.

A pharmaceutical composition of the invention is formulated to be compatible with its intended route of administration. Examples of routes of administration include parenteral, e.g., intravenous, intradermal, subcutaneous, oral (e.g., inhalation), transdermal (topical), transmucosal, intramuscular and rectal administration. Solutions or suspensions used for parenteral, intradermal, or subcutaneous application can include the following components: a sterile diluent such as water for injection, saline solution, fixed oils, polyethylene glycols, glycerine, propylene glycol or other synthetic solvents; antibacterial agents such as benzyl alcohol or methyl parabens; antioxidants such as ascorbic acid or sodium bisulfite; chelating agents such as ethylenediaminetetraacetic acid; buffers such as acetates, citrates or phosphates and agents for the adjustment of tonicity such as sodium chloride or dextrose. pH can be adjusted with acids or bases, such as hydrochloric acid or sodium hydroxide. The parenteral preparation can be enclosed in ampoules, disposable syringes or multiple dose vials made of glass or plastic.

Pharmaceutical compositions suitable for injectable use include sterile aqueous solutions (where water soluble) or dispersions and sterile powders for the extemporaneous preparation of sterile injectable solutions or dispersions. For intravenous administration, suitable carriers include physiological saline, bacteriostatic water, Cremophor EL (BASF; Parsippany, N.J.) or phosphate buffered saline (PBS). In all cases, the composition must be sterile and should be fluid to the extent that easy syringability exists. It must be stable under the conditions of manufacture and storage and must be preserved against the contaminating action of microorganisms such as bacteria and fungi. The carrier can be a solvent or dispersion medium containing, for example, water, ethanol, polyol (for example, glycerol, propylene glycol, and liquid polyetheylene glycol, and the like), and suitable mixtures thereof. The proper fluidity can be maintained, for example, by the use of a coating such as lecithin, by the maintenance of the required particle size in the case of dispersion and by the use of surfactants. Prevention of the action of microorganisms can be achieved by various antibacterial and antifungal agents, for example, parabens, chlorobutanol, phenol, ascorbic acid, thimerosal, and the like. In many cases, it will be preferable to include isotonic agents, for example, sugars, polyalcohols such as mannitol, sorbitol, sodium chloride in the composition. Prolonged absorption of the injectable compositions can be brought about by including in the composition an agent which delays absorption, for example, aluminum monostearate and gelatin.

Sterile injectable solutions can be prepared by incorporating the active compound (e.g., a Delta3, FTHMA-070, Tango85, Tango77, SPOIL, NEOKINE, Tango129 or A259 protein or anti-Delta3, FTHMA-070, Tango85, Tango77, SPOIL, NEOKINE, Tango129 or A259 antibody) in the required amount in an appropriate solvent with one or a combination of ingredients enumerated above, as required, followed by filtered sterilization. Generally, dispersions are prepared by incorporating the active compound into a sterile vehicle which contains a basic dispersion medium and the required other ingredients from those enumerated above. In the case of sterile powders for the preparation of sterile injectable solutions, the preferred methods of preparation are vacuum drying and freeze-drying which yields a powder of the active ingredient plus any additional desired ingredient from a previously sterile-filtered solution thereof.

Oral compositions generally include an inert diluent or an edible carrier. They can be enclosed in gelatin capsules or compressed into tablets. For the purpose of oral therapeutic administration, the active compound can be incorporated with excipients and used in the form of tablets, troches, or capsules. Oral compositions can also be prepared using a fluid carrier for use as a mouthwash, wherein the compound in the fluid carrier is applied orally and swished and expectorated or swallowed.

Pharmaceutically compatible binding agents, and/or adjuvant materials can be included as part of the composition. The tablets, pills, capsules, troches and the like can contain any of the following ingredients, or compounds of a similar nature: a binder such as microcrystalline cellulose, gum tragacanth or gelatin; an excipient such as starch or lactose, a disintegrating agent such as alginic acid, Primogel, or corn starch; a lubricant such as magnesium stearate or Sterotes; a glidant such as colloidal silicon dioxide; a sweetening agent such as sucrose or saccharin; or a flavoring agent such as peppermint, methyl salicylate, or orange flavoring.

For administration by inhalation, the compounds are delivered in the form of an aerosol spray from a pressurized container or dispenser which contains a suitable propellant, e.g., a gas such as carbon dioxide, or a nebulizer.

Systemic administration can also be by transmucosal or transdermal means. For transmucosal or transdermal administration, penetrants appropriate to the barrier to be permeated are used in the formulation. Such penetrants are generally known in the art, and include, for example, for transmucosal administration, detergents, bile salts, and fusidic acid derivatives. Transmucosal administration can be accomplished through the use of nasal sprays or suppositories. For transdermal administration, the active compounds are formulated into ointments, salves, gels, or creams as generally known in the art.

The compounds can also be prepared in the form of suppositories (e.g., with conventional suppository bases such as cocoa butter and other glycerides) or retention enemas for rectal delivery.

In one embodiment, the active compounds are prepared with carriers that will protect the compound against rapid elimination from the body, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, and polylactic acid. Methods for preparation of such formulations will be apparent to those skilled in the art. The materials can also be obtained commercially from Alza Corporation and Nova Pharmaceuticals, Inc. Liposomal suspensions (including liposomes targeted to infected cells with monoclonal antibodies to viral antigens) can also be used as pharmaceutically acceptable carriers. These can be prepared according to methods known to those skilled in the art, for example, as described in U.S. Pat. No. 4,522,811.

It is especially advantageous to formulate oral or parenteral compositions in dosage unit form for ease of administration and uniformity of dosage. Dosage unit form as used herein refers to physically discrete units suited as unitary dosages for the subject to be treated; each unit containing a predetermined quantity of active compound calculated to produce the desired therapeutic effect in association with the required pharmaceutical carrier. The specification for the dosage unit forms of the invention are dictated by and directly dependent on the unique characteristics of the active compound and the particular therapeutic effect to be achieved, and the limitations inherent in the art of compounding such an active compound for the treatment of individuals.

For antibodies, the preferred dosage is 0.1 mg/kg to 100 mg/kg of body weight (generally 10 mg/kg to 20 mg/kg). If the antibody is to act in the brain, a dosage of 50 mg/kg to 100 mg/kg is usually appropriate. Generally, partially human antibodies and fully human antibodies have a longer half-life within the human body than other antibodies. Accordingly, lower dosages and less frequent administration is often possible. Modifications such as lipidation can be used to stabilize antibodies and to enhance uptake and tissue penetration (e.g., into the brain). A method for lipidation of antibodies is described by Cruikshank et al. ((1997) *J. Acquired Immune Deficiency Syndromes and Human Retrovirology* 14:193).

As defined herein, a therapeutically effective amount of protein or polypeptide (i.e., an effective dosage) ranges from about 0.001 to 30 mg/kg body weight, preferably about 0.01 to 25 mg/kg body weight, more preferably about 0.1 to 20 mg/kg body weight, and even more preferably about 1 to 10 mg/kg, 2 to 9 mg/kg, 3 to 8 mg/kg, 4 to 7 mg/kg, or 5 to 6 mg/kg body weight.

With regard to antibodies which are to act in the brain, a dosage of 50 mg/kg to 100 mg/kg is typically appropriate. Generally, partially human antibodies and fully human antibodies have a longer half-life within the human body than other antibodies. Accordingly, lower dosages and less frequent administration is often possible. Modifications such as lipidation can be used to stabilize antibodies and to enhance uptake and tissue penetration (e.g., into the brain). A method for lipidation of antibodies is described by Cruikshank et al. ((1997) *J. Acquired Immune Deficiency Syndromes and Human Retrovirology* 14:193).

Toxicity and therapeutic efficacy of such compounds can be determined by standard pharmaceutical procedures in cell cultures or experimental animals, e.g., for determining the LD50 (the dose lethal to 50% of the population) and the ED50 (the dose therapeutically effective in 50% of the population). The dose ratio between toxic and therapeutic effects is the therapeutic index and it can be expressed as the ratio LD50/ED50. Compounds which exhibit large therapeutic indices are preferred. While compounds that exhibit toxic side effects may be used, care should be taken to design a delivery system that targets such compounds to the site of affected tissue in order to minimize potential damage to uninfected cells and, thereby, reduce side effects.

The data obtained from the cell culture assays and animal studies can be used in formulating a range of dosage for use in humans. The dosage of such compounds lies preferably within a range of circulating concentrations that include the ED50 with little or no toxicity. The dosage may vary within this range depending upon the dosage form employed and the route of administration utilized. For any compound used in the method of the invention, the therapeutically effective dose can be estimated initially from cell culture assays. A dose may be formulated in animal models to achieve a circulating plasma concentration range that includes the IC50 (i.e., the concentration of the test compound which achieves a half-maximal inhibition of symptoms) as determined in cell culture. Such information can be used to more accurately determine useful doses in humans. Levels in plasma may be measured, for example, by high performance liquid chromatography.

The skilled artisan will appreciate that certain factors may influence the dosage required to effectively treat a subject, including but not limited to the severity of the disease or disorder, previous treatments, the general health and/or age of the subject, and other diseases present. Moreover, treatment of a subject with a therapeutically effective amount of a protein, polypeptide, or antibody can include a single treatment or, preferably, can include a series of treatments. In one embodiment, a subject is treated with a protein, or polypeptide in the range of between about 0.1 to 20 mg/kg body weight, one time per week for between about 1 to 10 weeks, preferably between about 2 to 8 weeks, more preferably between about 3 to 8 weeks, and even more preferably for about 4, 5, or 6 weeks. It will also be appreciated that the effective dosage of antibody, protein, or polypeptide used for treatment may increase or decrease over the course of a particular treatment. Changes in dosage may result and become apparent from the results of diagnostic assays as described herein.

The nucleic acid molecules of the invention can be inserted into vectors and used as gene therapy vectors. Gene therapy vectors can be delivered to a subject by, for example, intravenous injection, local administration (U.S. Pat. No. 5,328, 470) or by stereotactic injection (see, e.g., Chen et al. (1994) *Proc. Natl. Acad. Sci. USA* 91:3054-3057). The pharmaceutical preparation of the gene therapy vector can include the gene therapy vector in an acceptable diluent, or can comprise a slow release matrix in which the gene delivery vehicle is imbedded. Alternatively, where the complete gene delivery vector can be produced intact from recombinant cells, e.g. retroviral vectors, the pharmaceutical preparation can include one or more cells which produce the gene delivery system.

The pharmaceutical compositions can be included in a container, pack, or dispenser together with instructions for administration.

In clinical settings, the gene delivery systems for the therapeutic Delta3 gene can be introduced into a patient by any of a number of methods, each of which is familiar in the art. For instance, a pharmaceutical preparation of the gene delivery system can be introduced systemically, e.g., by intravenous injection, and specific transduction of the protein in the target cells occurs predominantly from specificity of transfection provided by the gene delivery vehicle, cell-type or tissue-type expression due to the transcriptional regulatory sequences controlling expression of the receptor gene, or a combination thereof. In other embodiments, initial delivery of the recombinant gene is more limited with introduction into the animal being quite localized. For example, the gene delivery vehicle can be introduced by catheter (see U.S. Pat. No. 5,328,470) or by stereotactic injection (e.g., Chen et al. (1994) *Proc. Natl. Aacd. Sci. USA* 91: 3054-3057). A Delta3 gene, such as any one of the sequences represented in the group consisting of SEQ ID NOs: 1, 3, 24, 26, 27, 29, 31, 33, 35, 37, 39, 41, 43 or 45, or a sequence homologous thereto can be delivered in a gene therapy construct by electroporation using techniques described, for example, by Dev et al. ((1994) *Cancer Treat. Rev.* 20:105-115).

The pharmaceutical preparation of the gene therapy construct can consist essentially of the gene delivery system in an acceptable diluent, or can comprise a slow release matrix in which the gene delivery vehicle is imbedded. Alternatively, where the complete gene delivery system can be produced intact from recombinant cells, e.g., retroviral vectors, the pharmaceutical preparation can comprise one or more cells which produce the gene delivery system.

The compositions may, if desired, be presented in a pack or dispenser device which may contain one or more unit dosage forms containing the active ingredient. The pack may for example comprise metal or plastic foil, such as a blister pack. The pack or dispenser device may be accompanied by instructions for administration.

Uses and Methods of the Invention

The nucleic acid molecules, proteins, protein homologues, and antibodies described herein can be used in one or more of the following methods: a) screening assays; b) detection assays (e.g., chromosomal mapping, tissue typing, forensic biology), c) predictive medicine (e.g., diagnostic assays, prognostic assays, monitoring clinical trials, and pharmacogenomics); and d) methods of treatment (e.g., therapeutic and prophylactic). The isolated nucleic acid molecules of the invention can be used to express FTHMA-070, Tango85, Tango77 or A259 protein (e.g., via a recombinant expression vector in a host cell in gene therapy applications), to detect FTHMA-070, Tango85, Tango77 or A259 mRNA (e.g., in a biological sample) or a genetic lesion in a FTHMA-070, Tango85, Tango77 or A259 gene, and to modulate FTHMA-070, Tango85, Tango77 or A259 activity. In addition, the FTHMA-070, Tango85, Tango77 or A259 proteins can be used to screen drugs or compounds which modulate the FTHMA-070, Tango85, Tango77 or A259 activity or expression as well as to treat disorders characterized by insufficient or excessive production of FTHMA-070, Tango85, Tango77 or A259 protein or production of FTHMA-070, Tango85, Tango77 or A259 protein forms which have decreased or aberrant activity compared to FTHMA-070, Tango85, Tango77 or A259 wild type protein. In addition, the anti-FTHMA-070, Tango85, Tango77 or A259 antibodies of the invention can be used to detect and isolate FTHMA-070, Tango85, Tango77 or A259 proteins and modulate FTHMA-070, Tango85, Tango77 or A259 activity.

The nucleic acid molecules, proteins, protein homologues, and antibodies described herein can be used in one or more of the following methods: a) screening assays; b) detection assays (e.g., chromosomal mapping, tissue typing, forensic biology), c) predictive medicine (e.g., diagnostic assays, prognostic assays, monitoring clinical trials); and d) methods of treatment (e.g., therapeutic and prophylactic methods as well as such methods in the context of pharmacogenomics). As described herein, a SPOIL protein of the invention has one or more of the following activities: (i) interaction of a SPOIL protein in the extracellular milieu with a protein molecule on the surface of the same cell which secreted the SPOIL protein molecule (e.g., a SPOIL receptor or IL-1 receptor); (ii) interaction of a SPOIL protein in the extracellular milieu with a protein molecule on the surface of a different cell from that which secreted the SPOIL protein molecule (e.g., a SPOIL receptor or IL-1 receptor); (iii) complex formation between a SPOIL protein and a cell-surface receptor; (iv) interaction of a SPOIL protein with a target molecule in the extracellular milieu, and (v) interaction of the SPOIL protein with a target molecule in the cytoplasm of a cell, and can thus be used in, for example (1) regulating a signal transduction pathway (e.g., an IL-1-dependent or SPOIL-dependent pathway; (2) modulating cytokine production and/or secretion; (3) modulating lymphokine production and/or secretion; (4) modulating production of adhesion molecules; (5) modulation of nuclear transcription factors; (6) modulating secretion of IL-1; (7) competing with IL-1 to bind an IL-1 receptor; (8) modulating a proinflammatory cytokine; (9) modulating cell proliferation, development or differentiation (e.g., IL-1-stimulated or SPOIL stimulated); (10) modulating bone metabolism (e.g., bone formation and reabsorption); and (11) mediating cellular "acute phase" response. The isolated nucleic acid molecules of the invention can be used, for example, to express SPOIL protein (e.g., via a recombinant expression vector in a host cell in gene therapy applications), to detect SPOIL mRNA (e.g., in a biological sample) or a genetic alteration in an SPOIL gene, and to modulate IL-1 activity, as described further below. In addition, the SPOIL proteins can be screened which modulate the SPOIL activity as well as to treat disorders characterized by insufficient or excessive production of IL-1 which have decreased or aberrant activity compared to normal IL-1 expression (e.g., inflammatory diseases, e.g., rheumatoid arthritis, sepsis, stroke or diabetes, or IL-1 stimulated differentiative or developmental disorders such as bone metabolism disorders, e.g., osteoporosis, Paget's disease of bone, hypercalcemia of malignancy or osteolytic metastases, or diseases that involve the bowel and are characterized by the production of inflammation and/or ulceration in the small or large bowel including, e.g., inflammatory bowl disease (IBD), Crohn's disease, irritable bowel syndrome (IBS) and ulcerative colitis. Soluble forms of the SPOIL protein can be used to bind IL-1 receptors and influence bioavailability of such a receptors cognate ligand. In addition, the anti-SPOIL antibodies of the invention can be used to detect and isolate SPOIL proteins.

The nucleic acid molecules, proteins, protein homologues, and antibodies described herein can be used in one or more of the following methods: a) screening assays; b) predictive medicine (e.g., diagnostic assays, prognostic assays, monitoring clinical trials, and pharmacogenetics); and c) methods of treatment (e.g., therapeutic and prophylactic). As described herein, a NEOKINE protein of the invention has one or more of the following activities: (i) interaction of a NEOKINE protein with a membrane-bound NEOKINE receptor; (ii) interaction of a NEOKINE protein with a membrane-bound chemokine receptor; (iii) indirect interaction of a NEOKINE protein with an intracellular protein via a membrane-bound NEOKINE receptor; (iv) indirect interaction of a NEOKINE protein with an intracellular protein via a membrane-bound chemokine receptor; (v) complex formation between a soluble NEOKINE protein and a NEOKINE binding partner; (vi) inhibition of the interaction of chemokines (e.g., pro-inflammatory chemokines) by binding to their cognate receptors; (vii) inhibition of the binding of HIV to HIV co-receptors; and (vii) inhibition of the binding of HIV to HIV co-receptors wherein said binding induces subsequent infection of susceptible cells and can thus be used in, for example, (1) modulation of cellular signal transduction, either in vitro or in vivo; (2) regulation of gene transcription in a cell expressing a NEOKINE receptor or a chemokine receptor; (3) regulation of gene transcription in a cell expressing a NEOKINE receptor or a chemokine receptor, wherein said cell is involved in angiogenesis or inflammation; (4) regulation of angiogenesis; (5) regulation of angiogenesis, wherein said regulation comprises inhibition of angiogenesis; (6) regulation of angiogenesis, wherein said regulation comprises maintenance of angiostasis; (7) regulation of inflammation; and (8) regulation of inflammation, wherein said regulation comprises inhibition of chemoattraction (e.g., neutrophil chemoattraction), inhibition of inflammation, inhibition of inflammation by blocking the action of pro-inflammatory chemokines by binding to their cognate receptors, inhibition of psoriasis, suppression of immune rejection following skin graft, suppression of immune rejection following kidney transplant, inhibition of kidney inflammation in acute renal failure, inhibition of brain inflammation following stroke or ischaemia, or inhibition of brain inflammation following viral infection. The isolated nucleic acid molecules of the invention can be used, for example, to express NEOKINE protein (e.g., via a recombinant expression vector in a host cell in gene therapy applications), to detect NEOKINE mRNA (e.g., in a biological sample) or a genetic alteration in a NEOKINE gene, and to modulate NEOKINE activity, as described further below. The NEOKINE proteins can be used to treat disorders characterized by insufficient or excessive production of a non-NEOKINE chemokine or production of chemokine forms which have decreased or aberrant activity compared to wild type chemokines. In addition, the NEOKINE proteins can be used to screen drugs or compounds which modulate the NEOKINE activity as well as to treat disorders characterized by insufficient or excessive production of NEOKINE protein or production of NEOKINE protein forms which have decreased or aberrant activity compared to NEOKINE wild type protein. Moreover, the anti-NEOKINE antibodies of the invention can be used to detect and isolate NEOKINE proteins, regulate the bioavailability of NEOKINE proteins, and modulate NEOKINE activity.

The nucleic acid molecules, proteins, protein homologues, and antibodies described herein can be used in one or more of the following methods: a) screening assays; b) detection assays (e.g., chromosomal mapping, tissue typing, forensic biology), c) predictive medicine (e.g., diagnostic assays, prognostic assays, monitoring clinical trials, and pharmacogenomics); and d) methods of treatment (e.g., therapeutic and prophylactic). A T129 protein interacts with other cellular proteins and can thus be used for (i) regulation of cellular proliferation; (ii) regulation of cellular differentiation; and (iii) regulation of cell survival. The isolated nucleic acid molecules of the invention can be used to express T129 protein (e.g., via a recombinant expression vector in a host cell in gene therapy applications), to detect T129 mRNA (e.g., in a biological sample) or a genetic lesion in a T129 gene, and to modulate T129 activity. In addition, the T129 proteins can be used to screen drugs or compounds which modulate the T129 activity or expression as well as to treat disorders characterized by insufficient or excessive production of T129 protein or production of T129 protein forms which have decreased or aberrant activity compared to T129 wild type protein. In addition, the anti-T129 antibodies of the invention can be used to detect and isolate T129 proteins and modulate T129 activity.

This invention further pertains to novel agents identified by the above-described screening assays and uses thereof for treatments as described herein.

FTHMA-070, T85, T129 or A259 Screening Assays

The invention provides a method (also referred to herein as a "screening assay") for identifying modulators, i.e., candidate or test compounds or agents (e.g., peptides, peptidomimetics, small molecules or other drugs) which bind to FTHMA-070, T85, T129 or A259 proteins or have a stimulatory or inhibitory effect on, for example, FTHMA-070, T85, T129 or A259 expression or FTHMA-070, T85, T129 or A259 activity.

In one embodiment, the invention provides assays for screening candidate or test compounds which bind to or modulate the activity of the membrane-bound form of a FTHMA-070, T85, T129 or A259 protein or polypeptide or biologically active portion thereof. The test compounds of the present invention can be obtained using any of the numerous approaches in combinatorial library methods known in the art, including: biological libraries; spatially addressable parallel solid phase or solution phase libraries; synthetic library methods requiring deconvolution; the 'one-bead one-compound' library method; and synthetic library methods using affinity chromatography selection. The biological library approach is limited to peptide libraries, while the other four approaches are applicable to peptide, non-peptide oligomer or small molecule libraries of compounds (Lam, (1997) *Anticancer Drug Des.* 12:145).

Examples of methods for the synthesis of molecular libraries can be found in the art, for example in: DeWitt et al. (1993) *Proc. Natl. Acad. Sci. U.S.A.* 90:6909; Erb et al. (1994) *Proc. Natl. Acad. Sci. USA* 91:11422; Zuckermann et al. (1994). *J. Med. Chem.* 37:2678; Cho et al. (1993) Science 261:1303; Carrell et al. (1994) *Angew. Chem. Int. Ed. Engl.* 33:2059; Carell et al. (1994) Angew. Chem. Int. Ed. Engl. 33:2061; and Gallop et al. (1994) *J. Med. Chem.* 37:1233.

Libraries of compounds may be presented in solution (e.g., Houghten (1992) *Bio/Techniques* 13:412-421), or on beads (Lam (1991) *Nature* 354:82-84), chips (Fodor (1993) *Nature* 364:555-556), bacteria (U.S. Pat. No. 5,223,409), spores (U.S. Pat. Nos. 5,571,698; 5,403,484; and 5,223,409), plasmids (Cull et al. (1992) *Proc. Natl. Acad. Sci. USA* 89:1865-1869) or on phage (Scott and Smith (1990) *Science* 249:386-390; Devlin (1990) *Science* 249:404-406; Cwirla et al. (1990) *Proc. Natl. Acad. Sci.* 87:6378-6382; and Felici (1991) *J. Mol. Biol.* 222:301-310).

In one embodiment, an assay is a cell-based assay in which a cell which expresses a membrane-bound form of FTHMA-070, T85, T129 or A259 protein, or a biologically active portion thereof, on the cell surface is contacted with a test compound and the ability of the test compound to bind to a FTHMA-070, T85, T129 or A259 protein determined. The cell, for example, can be a yeast cell or a cell of mammalian origin. Determining the ability of the test compound to bind to the FTHMA-070, T85, T129 or A259 protein can be accomplished, for example, by coupling the test compound with a radioisotope or enzymatic label such that binding of the test compound to the FTHMA-070, T85, T129 or A259 protein or biologically active portion thereof can be determined by detecting the labeled compound in a complex. For example, test compounds can be labeled with $^{125}$I, $^{35}$S, $^{14}$C, or $^{3}$H, either directly or indirectly, and the radioisotope detected by direct counting of radioemission or by scintillation counting. Alternatively, test compounds can be enzymatically labeled with, for example, horseradish peroxidase, alkaline phosphatase, or luciferase, and the enzymatic label detected by determination of conversion of an appropriate substrate to product. In a preferred embodiment, the assay comprises contacting a cell which expresses a membrane-bound form of FTHMA-070, T85, T129 or A259 protein, or a biologically active portion thereof, on the cell surface with a known compound which binds FTHMA-070, T85, T129 or A259 to form an assay mixture, contacting the assay mixture with a test compound, and determining the ability of the test compound to interact with a FTHMA-070, T85, T129 or A259 protein, wherein determining the ability of the test compound to interact with a FTHMA-070, T85, T129 or A259 protein comprises determining the ability of the test compound to preferentially bind to FTHMA-070, T85, T129 or A259 or a biologically active portion thereof as compared to the known compound.

In another embodiment, an assay is a cell-based assay comprising contacting a cell expressing a membrane-bound form of FTHMA-070, T85, T129 or A259 protein, or a biologically active portion thereof, on the cell surface with a test compound and determining the ability of the test compound to modulate (e.g., stimulate or inhibit) the activity of the FTHMA-070, T85, T129 or A259 protein or biologically active portion thereof. Determining the ability of the test compound to modulate the activity of FTHMA-070, T85, T129 or A259 or a biologically active portion thereof can be accomplished, for example, by determining the ability of the FTHMA-070, T85, T129 or A259 protein to bind to or interact with a FTHMA-070, T85, T129 or A259 target molecule. As used herein, a "target molecule" is a molecule with which a FTHMA-070, T85, T129 or A259 protein binds or interacts in nature, for example, a molecule on the surface of a cell which expresses a FTHMA-070, T85, T129 or A259 protein, a molecule on the surface of a second cell, a molecule in the extracellular milieu, a molecule associated with the internal surface of a cell membrane or a cytoplasmic molecule. A FTHMA-070, T85, T129 or A259 target molecule can be a non-FTHMA-070, T85, T129 or A259 molecule or a FTHMA-070, T85, T129 or A259 protein or polypeptide of the present invention. In one embodiment, a FTHMA-070, T85, T129 or A259 target molecule is a component of a signal transduction pathway which facilitates transduction of an extracellular signal (e.g., a signal generated by binding of a compound to a membrane-bound FTHMA-070, T85, T129 or A259 molecule) through the cell membrane and into the cell. The target, for example, can be a second intercellular protein which has catalytic activity or a protein which facilitates the association of downstream signaling molecules with FTHMA-070, T85, T129 or A259.

Determining the ability of the FTHMA-070, T85, T129 or A259 polypeptide of the invention to bind to or interact with a target molecule can be accomplished by one of the methods described above for determining direct binding. As used herein, a "target molecule" is a molecule with which a selected polypeptide (e.g., a polypeptide of the invention) binds or interacts with in nature, for example, a molecule on the surface of a cell which expresses the selected protein, a molecule on the surface of a second cell, a molecule in the extracellular milieu, a molecule associated with the internal surface of a cell membrane or a cytoplasmic molecule. A target molecule can be a FTHMA-070, T85, T129 or A259 polypeptide of the invention or some other polypeptide or protein. For example, a target molecule can be a component of a signal transduction pathway which facilitates transduction of an extracellular signal (e.g., a signal generated by binding of a compound to a polypeptide of the invention) through the cell membrane and into the cell or a second intercellular protein which has catalytic activity or a protein which facilitates the association of downstream signaling molecules with a polypeptide of the invention. Determining the ability of a FTHMA-070, T85, T129 or A259 polypeptide of the invention to bind to or interact with a target molecule can be accomplished by determining the activity of the target molecule. For example, the activity of the target molecule can be determined by detecting induction of a cellular second messenger of the target (e.g., intracellular $Ca^{2+}$, diacylglycerol, IP3, etc.), detecting catalytic/enzymatic activity of the target on an appropriate substrate, detecting the induction of a reporter gene (e.g., a regulatory element that is responsive to a polypeptide of the invention operably linked to a nucleic acid encoding a detectable marker, e.g., luciferase), or detecting a cellular response, for example, cellular differentiation, or cell proliferation.

In yet another embodiment, an assay of the present invention is a cell-free assay comprising contacting a FTHMA-070, T85, T129 or A259 protein or biologically active portion thereof with a test compound and determining the ability of the test compound to bind to the FTHMA-070, T85, T129 or A259 protein or biologically active portion thereof. Binding of the test compound to the FTHMA-070, T85, T129 or A259 protein can be determined either directly or indirectly as described above. In a preferred embodiment, the assay includes contacting the FTHMA-070, T85, T129 or A259 protein or biologically active portion thereof with a known compound which binds FTHMA-070, T85, T129 or A259 to form an assay mixture, contacting the assay mixture with a test compound, and determining the ability of the test compound to interact with a FTHMA-070, T85, T129 or A259 protein, wherein determining the ability of the test compound to interact with a FTHMA-070, T85, T129 or A259 protein comprises determining the ability of the test compound to preferentially bind to FTHMA-070, T85, T129 or A259 or biologically active portion thereof as compared to the known compound.

In another embodiment, an assay is a cell-free assay comprising contacting FTHMA-070, T85, T129 or A259 protein or biologically active portion thereof with a test compound and determining the ability of the test compound to modulate (e.g., stimulate or inhibit) the activity of the FTHMA-070, T85, T129 or A259 protein or biologically active portion thereof. Determining the ability of the test compound to modulate the activity of FTHMA-070, T85, T129 or A259 can be accomplished, for example, by determining the ability of the FTHMA-070, T85, T129 or A259 protein to bind to a FTHMA-070, T85, T129 or A259 target molecule by one of the methods described above for determining direct binding. In an alternative embodiment, determining the ability of the test compound to modulate the activity of FTHMA-070, T85, T129 or A259 can be accomplished by determining the ability of the FTHMA-070, T85, T129 or A259 protein further modulate a FTHMA-070, T85, T129 or A259 target molecule. For example, the catalytic/enzymatic activity of the target molecule on an appropriate substrate can be determined as previously described.

In yet another embodiment, the cell-free assay comprises contacting the FTHMA-070, T85, T129 or A259 protein or biologically active portion thereof with a known compound which binds FTHMA-070, T85, T129 or A259 to form an assay mixture, contacting the assay mixture with a test compound, and determining the ability of the test compound to interact with a FTHMA-070, T85, T129 or A259 protein, wherein determining the ability of the test compound to interact with a FTHMA-070, T85, T129 or A259 protein comprises determining the ability of the FTHMA-070, T85, T129 or A259 protein to preferentially bind to or modulate the activity of a FTHMA-070, T85, T129 or A259 target molecule.

In the case of cell-free assays, it may be desirable to utilize a solubilizing agent such that the membrane-bound form of FTHMA-070, T85, T129 or A259 is maintained in solution. Examples of such solubilizing agents include non-ionic detergents such as n-octylglucoside, n-dodecylglucoside, n-dodecylmaltoside, octanoyl-N-methylglucamide, decanoyl-N-methylglucamide, Triton® X-100, Triton® X-114, Thesit®, Isotridecypoly(ethylene glycol ether)n, 3-[(3-cholamidopropyl)dimethylamminio]-1-propane sulfonate (CHAPS), 3-[(3-cholamidopropyl)dimethylamminio]-2-hydroxy-1-propane sulfonate (CHAPS O), or N-dodecyl=N,N-dimethyl-3-ammonio-1-propane sulfonate.

In more than one embodiment of the above assay methods of the present invention, it may be desirable to immobilize either FTHMA-070, T85, T129 or A259 or its target molecule to facilitate separation of complexed from uncomplexed forms of one or both of the proteins, as well as to accommodate automation of the assay. Binding of a test compound to FTHMA-070, T85, T129 or A259, or interaction of FTHMA-070, T85, T129 or A259 with a target molecule in the presence and absence of a candidate compound, can be accomplished in any vessel suitable for containing the reactants. Examples of such vessels include microtitre plates, test tubes, and micro-centrifuge tubes. In one embodiment, a fusion protein can be provided which adds a domain that allows one or both of the proteins to be bound to a matrix. For example, glutathione-S-transferase/FTHMA-070, T85, T129 or A259 fusion proteins or glutathione-S-transferase/target fusion proteins can be adsorbed onto glutathione sepharose beads (Sigma Chemical; St. Louis, Mo.) or glutathione derivatized microtitre plates, which are then combined with the test compound or the test compound and either the non-adsorbed target protein or FTHMA-070, T85, T129 or A259 protein, and the mixture incubated under conditions conducive to complex formation (e.g., at physiological conditions for salt and pH). Following incubation, the beads or microtitre plate wells are washed to remove any unbound components, the matrix immobilized in the case of beads, complex determined either directly or indirectly, for example, as described above. Alternatively, the complexes can be dissociated from the matrix, and the level of FTHMA-070, T85, T129 or A259 binding or activity determined using standard techniques.

Other techniques for immobilizing proteins on matrices can also be used in the screening assays of the invention. For example, either FTHMA-070, T85, T129 or A259 or its target molecule can be immobilized utilizing conjugation of biotin and streptavidin. Biotinylated FTHMA-070, T85, T129 or A259 or target molecules can be prepared from biotin-NHS (N-hydroxy-succinimide) using techniques well known in the art (e.g., biotinylation kit, Pierce Chemicals; Rockford, Ill.), and immobilized in the wells of streptavidin-coated 96 well plates (Pierce Chemical). Alternatively, antibodies reactive with FTHMA-070, T85, T129 or A259 or target molecules but which do not interfere with binding of the FTHMA-070, T85, T129 or A259 protein to its target molecule can be derivatized to the wells of the plate, and unbound target or FTHMA-070, T85, T129 or A259 trapped in the wells by antibody conjugation. Methods for detecting such complexes, in addition to those described above for the GST-immobilized complexes, include immunodetection of complexes using antibodies reactive with the FTHMA-070, T85, T129 or A259 or target molecule, as well as enzyme-linked assays which rely on detecting an enzymatic activity associated with the FTHMA-070, T85, T129 or A259 or target molecule.

In another embodiment, modulators of FTHMA-070, T85, T129 or A259 expression are identified in a method in which a cell is contacted with a candidate compound and the expression of FTHMA-070, T85, T129 or A259 mRNA or protein in the cell is determined. The level of expression of FTHMA-070, T85, T129 or A259 mRNA or protein in the presence of the candidate compound is compared to the level of expression of FTHMA-070, T85, T129 or A259 mRNA or protein in the absence of the candidate compound. The candidate compound can then be identified as a modulator of FTHMA-070, T85, T129 or A259 expression based on this comparison. For example, when expression of FTHMA-070, T85, T129 or A259 mRNA or protein is greater (statistically significantly greater) in the presence of the candidate compound than in its absence, the candidate compound is identified as a stimulator of FTHMA-070, T85, T129 or A259 mRNA or protein expression. Alternatively, when expression of FTHMA-070, T85, T129 or A259 mRNA or protein is less (statistically significantly less) in the presence of the candidate compound than in its absence, the candidate compound is identified as an inhibitor of FTHMA-070, T85, T129 or A259 mRNA or protein expression. The level of FTHMA-070, T85, T129 or A259 mRNA or protein expression in the cells can be determined by methods described herein for detecting FTHMA-070, T85, T129 or A259 mRNA or protein.

In yet another aspect of the invention, the FTHMA-070, T85, T129 or A259 proteins can be used as "bait proteins" in a two-hybrid assay or three hybrid assay (see, e.g., U.S. Pat. No. 5,283,317; Zervos et al. (1993) *Cell* 72:223-232; Madura et al. (1993) *J. Biol. Chem.* 268:12046-12054; Bartel et al. (1993) *Bio/Techniques* 14:920-924; Iwabuchi et al. (1993) *Oncogene* 8:1693-1696; and WO94/10300), to identify other proteins, which bind to or interact with FTHMA-070, T85, T129 or A259 and modulate FTHMA-070, T85, T129 or A259 activity. Such FTHMA-070, T85, T129 or A259-binding proteins are also likely to be involved in the propagation of signals by the FTHMA-070, T85, T129 or A259 proteins as, for example, upstream or downstream elements of the FTHMA-070, T85, T129 or A259 pathway.

The two-hybrid system is based on the modular nature of most transcription factors, which consist of separable DNA-binding and activation domains. Briefly, the assay utilizes two different DNA constructs. In one construct, the gene that codes for FTHMA-070, T85, T129 or A259 is fused to a gene encoding the DNA binding domain of a known transcription factor (e.g., GAL-4). In the other construct, a DNA sequence, from a library of DNA sequences, that encodes an unidentified protein ("prey" or "sample") is fused to a gene that codes for the activation domain of the known transcription factor. If the "bait" and the "prey" proteins are able to interact, in vivo, forming an FTHMA-070, T85, T129 or A259-dependent complex, the DNA-binding and activation domains of the transcription factor are brought into close proximity. This proximity allows transcription of a reporter gene (e.g., LacZ) which is operably linked to a transcriptional regulatory site responsive to the transcription factor. Expression of the reporter gene can be detected and cell colonies containing the functional transcription factor can be isolated and used to obtain the cloned gene which encodes the protein which interacts with FTHMA-070, T85, T129 or A259.

This invention further pertains to novel agents identified by the above-described screening assays and uses thereof for treatments as described herein.

Tango-77 Screening Assays

The invention provides a method (also referred to herein as a "screening assay") for identifying modulators, i.e., candidate or test compounds or agents (e.g., peptides, peptidomimetics, small molecules or other drugs) which bind to Tango-77 proteins or have a stimulatory or inhibitory effect on, for example, Tango-77 expression or Tango-77 activity.

Examples of methods for the synthesis of molecular libraries can be found in the art, for example in: DeWitt et al. (1993) *Proc. Natl. Acad. Sci. USA* 90:6909; Erb et al. (1994) *Proc. Natl. Acad. Sci. USA* 91:11422; Zuckermann et al. (1994). *J. Med. Chem.* 37:2678; Cho et al. (1993) Science 261:1303; Carrell et al. (1994) *Angew. Chem. Int. Ed. Engl.* 33:2059; Carell et al. (1994) Angew. Chem. Int. Ed. Engl. 33:2061; and Gallop et al. (1994) *J. Med. Chem.* 37:1233.

Libraries of compounds may be presented in solution (e.g., Houghten (1992) *Bio/Techniques* 13:412-421), or on beads (Lam (1991) *Nature* 354:82-84), chips (Fodor (1993) *Nature* 364:555-556), bacteria (U.S. Pat. No. 5,223,409), spores (U.S. Pat. Nos. 5,571,698; 5,403,484; and 5,223,409), plasmids (Cull et al. (1992) *Proc. Natl. Acad. Sci. USA* 89:1865-1869) or phage (Scott and Smith (1990) *Science* 249:386-390; Devlin (1990) *Science* 249:404-406; Cwirla et al. (1990) *Proc. Natl. Acad. Sci. USA* 87:6378-6382; and Felici (1991) *J. Mol. Biol.* 222:301-310).

In another embodiment, an assay is used to determine the ability of the test compound to modulate the activity of Tango-77 or a biologically active portion thereof, for example, by determining the ability of the Tango-77 protein to bind to or interact with a Tango-77 target molecule. As used herein, a "target molecule" is a molecule with which a Tango-77 protein binds or interacts in nature, for example, a molecule on the surface of a cell. A Tango-77 target molecule can be a non-Tango-77 molecule or a Tango-77 protein or polypeptide of the present invention. In one embodiment, a Tango-77 target molecule is a component of a signal transduction pathway, for example, Tango-77 may bind to a IL-1 receptor or another receptor thereby blocking the receptor and inhibiting future signal transduction. Determining the ability of the Tango-77 protein to bind to or interact with a Tango-77 target molecule can be accomplished by one of the methods described above. In a preferred embodiment, determining the ability of the Tango-77 protein to bind to or interact with a Tango-77 target molecule can be accomplished by determining the activity of the target molecule. For example, the activity of the target molecule can be determined by detecting induction of a cellular second messenger of the target (e.g., intracellular $Ca^{2+}$, diacylglycerol, IP3, etc.), detecting catalytic/enzymatic activity of the target on an appropriate substrate, detecting the induction of a reporter gene (e.g., a Tango-77-responsive regulatory element operably linked to a nucleic acid encoding a detectable marker, e.g. luciferase), or detecting a cellular response, for example, inflammation.

In yet another embodiment, an assay of the present invention is a cell-free assay comprising contacting a Tango-77 protein or biologically active portion thereof with a test compound and determining the ability of the test compound to bind to the Tango-77 protein or biologically active portion thereof. Binding of the test compound to the Tango-77 protein can be determined either directly or indirectly as described above. In a preferred embodiment, the assay includes contacting the Tango-77 protein or biologically active portion thereof with a known compound which binds Tango-77 to form an assay mixture, contacting the assay mixture with a test compound, and determining the ability of the test compound to interact with a Tango-77 protein, wherein determining the ability of the test compound to interact with a Tango-77 protein comprises determining the ability of the test compound to preferentially bind to Tango-77 or biologically active portion thereof as compared to the known compound.

In another embodiment, an assay is a cell-free assay comprising contacting Tango-77 protein or biologically active portion thereof with a test compound and determining the ability of the test compound to modulate (e.g., stimulate or inhibit) the activity of the Tango-77 protein or biologically active portion thereof. Determining the ability of the test compound to modulate the activity of Tango-77 can be accomplished, for example, by determining the ability of the Tango-77 protein to bind to a Tango-77 target molecule by one of the methods described above for determining direct binding. In an alternative embodiment, determining the ability of the test compound to modulate the activity of Tango-77 can be accomplished by determining the ability of the Tango-77 protein to further modulate a Tango-77 target molecule. For example, the catalytic/enzymatic activity of the target molecule on an appropriate substrate can be determined as previously described.

In yet another embodiment, the cell-free assay comprises contacting the Tango-77 protein or biologically active portion thereof with a known compound which binds Tango-77 to form an assay mixture, contacting the assay mixture with a test compound, and determining the ability of the test compound to interact with a Tango-77 protein, wherein determining the ability of the test compound to interact with a Tango-77 protein comprises determining the ability of the Tango-77 protein to preferentially bind to or modulate the activity of a Tango-77 target molecule.

It is possible that membrane-bound forms of Tango-77 exist. The cell-free assays of the present invention are amenable to use of both the forms Tango-77. In the case of cell-free assays comprising a membrane-bound form of Tango-77, it may be desirable to utilize a solubilizing agent such that the membrane-bound form of Tango-77 is maintained in solution. Examples of such solubilizing agents include non-ionic detergents such as n-octylglucoside, n-dodecylglucoside, n-dodecylmaltoside, octanoyl-N-methylglucamide, decanoyl-N-methylglucamide, Triton® X-100, Triton® X-114, Thesit®, Isotridecypoly(ethylene glycol ether)n, 3-[(3-cholamidopropyl)dimethylamminio]-1-propane sulfonate (CHAPS), 3-[(3-cholamidopropyl)dimethylamminio]-2-hydroxy-1-propane sulfonate (CHAPS O), or N-dodecyl=N,N-dimethyl-3-ammonio-1-propane sulfonate.

In more than one embodiment of the above assay methods of the present invention, it may be desirable to immobilize either Tango-77 or its target molecule to facilitate separation of complexed from uncomplexed forms of one or both of the proteins, as well as to accommodate automation of the assay. Binding of a test compound to Tango-77, or interaction of Tango-77 with a target molecule in the presence and absence of a candidate compound, can be accomplished in any vessel suitable for containing the reactants. Examples of such vessels include microtitre plates, test tubes, and micro-centrifuge tubes. In one embodiment, a fusion protein can be provided which adds a domain that allows one or both of the proteins to be bound to a matrix. For example, glutathione-S-transferase/Tango-77 fusion proteins or glutathione-S-transferase/target fusion proteins can be adsorbed onto glutathione sepharose beads (Sigma Chemical Co.; St. Louis, Mo.) or glutathione derivatized microtitre plates, which are then combined with the test compound or the test compound and either the non-adsorbed target protein or Tango-77 protein, and the mixture incubated under conditions conducive to complex formation (e.g., at physiological conditions for salt and pH). Following incubation, the beads or microtitre plate wells are washed to remove any unbound components and complex formation is measured either directly or indirectly, for example, as described above. Alternatively, the complexes can be dissociated from the matrix, and the level of Tango-77 binding or activity determined using standard techniques.

Other techniques for immobilizing proteins on matrices can also be used in the screening assays of the invention. For example, either Tango-77 or its target molecule can be immobilized utilizing conjugation of biotin and streptavidin. Biotinylated Tango-77 or target molecules can be prepared from biotin-NHS(N-hydroxy-succinimide) using techniques well known in the art (e.g., biotinylation kit, Pierce Chemicals; Rockford, Ill.), and immobilized in the wells of streptavidin-coated 96 well plates (Pierce Chemical). Alternatively, antibodies reactive with Tango-77 or target molecules but which do not interfere with binding of the Tango-77 protein to its target molecule can be derivatized to the wells of the plate, and unbound target or Tango-77 trapped in the wells by antibody conjugation. Methods for detecting such complexes, in addition to those described above for the GST-immobilized complexes, include immunodetection of complexes using antibodies reactive with the Tango-77 or target molecule, as well as enzyme-linked assays which rely on detecting an enzymatic activity associated with the Tango-77 or target molecule.

In another embodiment, modulators of Tango-77 expression are identified in a method in which a cell is contacted with a candidate compound and the expression of Tango-77 mRNA or protein in the cell is determined. The level of expression of Tango-77 mRNA or protein in the presence of the candidate compound is compared to the level of expression of Tango-77 mRNA or protein in the absence of the candidate compound. The candidate compound can then be identified as a modulator of Tango-77 expression based on this comparison. For example, when expression of Tango-77 mRNA or protein is greater (statistically significantly greater) in the presence of the candidate compound than in its absence, the candidate compound is identified as a stimulator of Tango-77 mRNA or protein expression. Alternatively, when expression of Tango-77 mRNA or protein is less (statistically significantly less) in the presence of the candidate compound than in its absence, the candidate compound is identified as an inhibitor of Tango-77 mRNA or protein expression. The level of Tango-77 mRNA or protein expression in the cells can be determined by methods described herein for detecting Tango-77 mRNA or protein.

In yet another aspect of the invention, the Tango-77 proteins can be used as "bait proteins" in a two-hybrid assay or three hybrid assay (see, e.g., U.S. Pat. No. 5,283,317; Zervos et al. (1993) *Cell* 72:223-232; Madura et al. (1993) *J. Biol. Chem.* 268:12046-12054; Bartel et al. (1993) *Bio/Techniques* 14:920-924; Iwabuchi et al. (1993) *Oncogene* 8:1693-1696; and PCT Publication No. WO 94/10300), to identify other proteins, which bind to or interact with Tango-77 ("Tango-77-binding proteins" or "Tango-77-bp") and modulate Tango-77 activity. Such Tango-77-binding proteins are also likely to be involved in the propagation of signals by the Tango-77 proteins as, for example, upstream or downstream elements of the Tango-77 pathway.

The two-hybrid system is based on the modular nature of most transcription factors, which consist of separable DNA-binding and activation domains. Briefly, the assay utilizes two different DNA constructs. In one construct, the gene that codes for Tango-77 is fused to a gene encoding the DNA binding domain of a known transcription factor (e.g., GAL-4). In the other construct, a DNA sequence, from a library of DNA sequences, that encodes an unidentified protein ("prey" or "sample") is fused to a gene that codes for the activation domain of the known transcription factor. If the "bait" and the "prey" proteins are able to interact, in vivo, forming an Tango-77-dependent complex, the DNA-binding and activation domains of the transcription factor are brought into close proximity. This proximity allows transcription of a reporter gene (e.g., LacZ) which is operably linked to a transcriptional regulatory site responsive to the transcription factor. Expression of the reporter gene can be detected and cell colonies containing the functional transcription factor can be isolated and used to obtain the cloned gene which encodes the protein which interacts with Tango-77.

This invention further pertains to novel agents identified by the above-described screening assays and uses thereof for treatments as described herein.

SPOIL Screening Assays:

The invention provides a method (also referred to herein as a "screening assay") for identifying modulators, i.e., candidate or test compounds or agents (e.g., peptides, peptidomimetics, small molecules or other drugs) which bind to SPOIL proteins or have a stimulatory or inhibitory effect on, for example, SPOIL expression or SPOIL activity and/or have a stimulatory or inhibitory effect on IL-1 stimulated activities.

In one embodiment, the invention provides assays for screening candidate or test compounds which bind to or modulate the activity of a SPOIL target molecule. The test compounds of the present invention can be obtained using any of the numerous approaches in combinatorial library methods known in the art, including: biological libraries; spatially addressable parallel solid phase or solution phase libraries; synthetic library methods requiring deconvolution; the 'one-bead one-compound' library method; and synthetic library methods using affinity chromatography selection. The biological library approach is limited to peptide libraries, while the other four approaches are applicable to peptide, non-peptide oligomer or small molecule libraries of compounds (Lam (1997) *Anticancer Drug Des.* 12:145).

Examples of methods for the synthesis of molecular libraries can be found in the art, for example in: DeWitt et al. (1993) *Proc. Natl. Acad. Sci. U.S.A.* 90:6909; Erb et al. (1994) *Proc. Natl. Acad. Sci. USA* 91:11422; Zuckermann et al. (1994). *J. Med. Chem.* 37:2678; Cho et al. (1993) *Science* 261:1303; Carrell et al. (1994) *Angew. Chem. Int. Ed. Engl.* 33:2059; Carell et al. (1994) *Angew. Chem. Int. Ed. Engl.* 33:2061; and in Gallop et al. (1994) *J. Med. Chem.* 37:1233.

Libraries of compounds may be presented in solution (e.g., Houghten (1992) *Biotechniques* 13:412-421), or on beads (Lam (1991) *Nature* 354:82-84), chips (Fodor (1993) *Nature* 364:555-556), bacteria (Ladner U.S. Pat. No. 5,223,409), spores (Ladner U.S. Pat. No. '409), plasmids (Cull et al. (1992) *Proc Natl Acad Sci USA* 89:1865-1869) or on phage (Scott and Smith (1990) *Science* 249:386-390); (Devlin (1990) *Science* 249:404-406); (Cwirla et al. (1990) *Proc. Natl. Acad. Sci.* 87:6378-6382); (Felici (1991) *J. Mol. Biol.* 222:301-310); (Ladner supra.).

In one embodiment, the screening assay comprises contacting a cell which expresses a SPOIL receptor on the cell surface with a SPOIL protein or biologically-active portion thereof, to form an assay mixture, contacting the assay mixture with a test compound, and determining the ability of the test compound to interact with a SPOIL receptor, wherein determining the ability of the test compound to interact with a SPOIL receptor comprises determining the ability of the test compound to preferentially bind to the SPOIL receptor as compared to the ability of SPOIL, or a biologically active portion thereof, to bind to the receptor. In addition, the screening assay can also comprise contacting a cell which expresses a SPOIL receptor on the cell surface with a SPOIL protein or biological portion thereof, and IL-1, to form a competitive binding assay. The binding assay can then be contacted with a test compound in order to determine the ability of the test compound to preferentially bind to the receptor as compared with the SPOIL protein or biological portion thereof and/or modulate IL-1 stimulated activity by the cell.

In another embodiment, an assay is a cell-based assay comprising contacting a cell expressing a SPOIL target molecule with a test compound and determining the ability of the test compound to modulate (e.g. stimulate or inhibit) the activity of the SPOIL target molecule. Determining the ability of the test compound to modulate the activity of a SPOIL target molecule can be accomplished, for example, by determining the ability of the SPOIL protein to bind to or interact with the SPOIL target molecule in the presence of the test compound. This assay can be performed in the presence of IL-1, and the ability of the SPOIL protein to interact with the target molecule can be determined by assessing the activity of a cell that is normally stimulated by IL-1 as compared to a control assay comprising cell expressing a SPOIL target molecule, SPOIL protein and IL-1 without the test compound.

Determining the ability of the SPOIL protein to bind to or interact with a SPOIL target molecule can be accomplished by determining the activity of the target molecule. For example, the activity of the target molecule can be determined by detecting induction or lack of induction of a cellular second messenger of the target (i.e. intracellular $Ca^{2+}$, diacylglycerol, $IP_3$, $PGE_2$, etc.), detecting catalytic/enzymatic activity of the target an appropriate substrate, detecting the induction of a reporter gene (comprising a SPOIL and/or IL-1-responsive regulatory element operatively linked to a nucleic acid encoding a detectable marker, e.g., luciferase), or detecting a cellular response or lack of a cellular response, for example, SPOIL and/or IL-1 stimulated development, differentiation or rate of proliferation.

In yet another embodiment, the assay is a cell-free assay in which a SPOIL protein or biologically active portion thereof is contacted with a test compound and the ability of the test compound to modulate (e.g., stimulate or inhibit) the activity of the SPOIL protein or biologically active portion thereof is determined. Determining the ability of the test compound to modulate the activity of a SPOIL protein can be accomplished, for example, by determining the ability of the SPOIL protein to bind to a SPOIL target molecule in the presence and/or absence of the test compound. Determining the ability of the test compound to modulate the activity of a SPOIL protein can be accomplished in the presence or absence of IL-1. Determining the ability of the SPOIL protein to bind to a SPOIL target molecule can also be accomplished using a technology such as real-time Biomolecular Interaction Analysis (BIA). Sjolander et al. (1991) *Anal. Chem.* 63:2338-2345 and Szabo et al. (1995) *Curr. Opin. Struct. Biol.* 5:699-705. As used herein, "BIA" is a technology for studying biospecific interactions in real time, without labeling any of the interactants (e.g., BIAcore™). Changes in the optical phenomenon surface plasmon resonance (SPR) can be used as an indication of real-time reactions between biological molecules.

In more than one embodiment of the above assay methods of the present invention, it may be desirable to immobilize either SPOIL or its target molecule to facilitate separation of complexed from uncomplexed forms of one or both of the proteins, as well as to accommodate automation of the assay. Binding of a test compound to a SPOIL protein, or interaction of a SPOIL protein with a target molecule in the presence and absence of a candidate compound, can be accomplished in any vessel suitable for containing the reactants. Examples of such vessels include microtitre plates, test tubes, and microcentrifuge tubes. In one embodiment, a fusion protein can be provided which adds a domain that allows one or both of the proteins to be bound to a matrix. For example, glutathione-S-transferase/SPOIL fusion proteins or glutathione-S-transferase/target fusion proteins can be adsorbed onto glutathione sepharose beads (Sigma Chemical, St. Louis, Mo.) or glutathione derivatized microtitre plates, which are then combined with the test compound or the test compound and either the non-adsorbed target protein or SPOIL protein, and the mixture incubated under conditions conducive to complex formation (e.g., at physiological conditions for salt and pH). Following incubation, the beads or microtitre plate wells are washed to remove any unbound components, the matrix immobilized in the case of beads, complex determined either directly or indirectly, for example, as described above. Alternatively, the complexes can be dissociated from the matrix, and the level of SPOIL binding or activity determined using standard techniques.

Other techniques for immobilizing proteins on matrices can also be used in the screening assays of the invention. For example, either a SPOIL protein or a SPOIL target molecule can be immobilized utilizing conjugation of biotin and streptavidin. Biotinylated SPOIL protein or target molecules can be prepared from biotin-NHS(N-hydroxy-succinimide) using techniques well known in the art (e.g., biotinylation kit, Pierce Chemicals, Rockford, Ill.), and immobilized in the wells of streptavidin-coated 96 well plates (Pierce Chemical). Alternatively, antibodies reactive with SPOIL protein or target molecules but which do not interfere with binding of the SPOIL protein to its target molecule can be derivatized to the wells of the plate, and unbound target or SPOIL protein trapped in the wells by antibody conjugation. Methods for detecting such complexes, in addition to those described above for the GST-immobilized complexes, include immunodetection of complexes using antibodies reactive with the SPOIL protein or target molecule, as well as enzyme-linked assays which rely on detecting an enzymatic activity associated with the SPOIL protein or target molecule.

In yet another aspect of the invention, the SPOIL proteins can be used as "bait proteins" in a two-hybrid assay or three-hybrid assay (see, e.g., U.S. Pat. No. 5,283,317; Zervos et al. (1993) *Cell* 72:223-232; Madura et al. (1993) *J. Biol. Chem.* 268:12046-12054; Bartel et al. (1993) *Biotechniques* 14:920-924; Iwabuchi et al. (1993) *Oncogene* 8:1693-1696; and Brent WO94/10300), to identify other proteins, which bind to or interact with SPOIL ("SPOIL-binding proteins" or "SPOIL-bp") and modulate SPOIL activity. Such SPOIL-binding proteins are also likely to be involved in the propagation of signals by the SPOIL proteins as, for example, downstream elements of a SPOIL-mediated signaling pathway. Alternatively, such SPOIL-binding proteins are likely to be cell-surface molecules associated with non-SPOIL expressing cells, wherein such SPOIL-binding proteins are involved in signal transduction.

The two-hybrid system is based on the modular nature of most transcription factors, which consist of separable DNA-binding and activation domains. Briefly, the assay utilizes two different DNA constructs. In one construct, the gene that codes for a SPOIL protein is fused to a gene encoding the DNA binding domain of a known transcription factor (e.g., GAL-4). In the other construct, a DNA sequence, from a library of DNA sequences, that encodes an unidentified protein ("prey" or "sample") is fused to a gene that codes for the activation domain of the known transcription factor. If the "bait" and the "prey" proteins are able to interact, in vivo, forming a SPOIL-dependent complex, the DNA-binding and activation domains of the transcription factor are brought into close proximity. This proximity allows transcription of a reporter gene (e.g., LacZ) which is operably linked to a transcriptional regulatory site responsive to the transcription factor. Expression of the reporter gene can be detected and cell colonies containing the functional transcription factor can be isolated and used to obtain the cloned gene which encodes the protein which interacts with the SPOIL protein.

This invention further pertains to novel SPOIL agents such as SPOIL proteins or biologically active portions thereof, SPOIL variants which function as IL-1 receptor agonists and nucleic acid molecules encoding a SPOIL protein or variant, which can be screened to determine the efficacy of such agents on various SPOIL and/or IL-1 stimulated activities (e.g., stimulated immune response, proliferation, signal transduction pathway, or differentiation).

In one embodiment, determining the ability of a SPOIL agent to modulate the activity of SPOIL and/or IL-1 can be accomplished by testing the ability of the agent to interfere with the proliferation of T cells in the presence of SPOIL and/or IL-1.

It is also within the scope of this invention to further use a SPOIL agent as described herein in an appropriate animal model. For example, an agent as described herein (e.g., a modulating agent) can be used in an animal model to determine the efficacy, toxicity, or side effects of treatment with such an agent. Alternatively, a SPOIL agent identified as described herein can be used in an animal model to determine the mechanism of action of such an agent. Animal models for use in determining the efficacy or mechanism of action of a SPOIL agent of the present invention include animal models demonstrating parameters of sepsis (e.g., animals injected with *E. coli* to induce hypotension) and animal models for determining bone metabolism (e.g., lethally irradiated mice which have been transplanted with SPOIL infected marrow cells). Other animal models which are recognized in the art as predictive of results in humans with various IL-1 induced disorders are known in the art and described, for example, in Dinarello (1991) *Blood* 77(8):1627-1652. Furthermore, this invention pertains to uses of SPOIL agents and agents identified by the above-described screening assays for treatments as described herein.

NEOKINE Screening Assays:

The invention provides a method (also referred to herein as a "screening assay") for identifying modulators, i.e., candidate or test compounds or agents (e.g., peptides, peptidomimetics, small molecules or other drugs) which bind to NEOKINE proteins, bind to NEOKINE receptors, have a stimulatory or inhibitory effect on, for example, NEOKINE expression, NEOKINE activity, or NEOKINE receptor activity (e.g., RDC1 activity), or have a stimulatory or inhibitory effect on, for example, the expression or activity of a non-NEOKINE chemokine or non-NEOKINE chemokine receptor. It will be appreciated by one of skill in the art that modulators identified by the screening assays defined herein (e.g., modulators of NEOKINE and/or NEOKINE receptor or RDC1) can be used in the prophylactic and therapeutic treatment of diseases and disorders associated with aberrant NEOKINE and/or NEOKINE receptor activity (e.g., proliferative disorders and diseases).

In one embodiment, the invention provides assays for screening candidate or test compounds which bind to or modulate the activity of a NEOKINE protein or polypeptide or biologically active portion thereof. In another embodiment, the invention provides assays for screening candidate or test compounds which bind to or modulate the activity of a NEOKINE receptor. The test compounds of the present invention can be obtained using any of the numerous approaches in combinatorial library methods known in the art, including: biological libraries; spatially addressable parallel solid phase or solution phase libraries; synthetic library methods requiring deconvolution; the 'one-bead one-compound' library method; and synthetic library methods using affinity chromatography selection. The biological library approach is limited to peptide libraries, while the other four approaches are applicable to peptide, non-peptide oligomer or small molecule libraries of compounds (Lam, K. S. (1997) *Anticancer Drug Des.* 12:145).

Examples of methods for the synthesis of molecular libraries can be found in the art, for example in: DeWitt et al. (1993) *Proc. Natl. Acad. Sci. U.S.A.* 90:6909; Erb et al. (1994) *Proc. Natl. Acad. Sci. USA* 91:11422; Zuckermann et al. (1994). *J. Med. Chem.* 37:2678; Cho et al. (1993) *Science* 261:1303; Carrell et al. (1994) *Angew. Chem. Int. Ed. Engl.* 33:2059; Carell et al. (1994) *Angew. Chem. Int. Ed. Engl.* 33:2061; and in Gallop et al. (1994) *J. Med. Chem.* 37:1233.

Libraries of compounds may be presented in solution (e.g., Houghten (1992) *Biotechniques* 13:412-421), or on beads (Lam (1991) *Nature* 354:82-84), chips (Fodor (1993) *Nature* 364:555-556), bacteria (Ladner U.S. Pat. No. 5,223,409), spores (Ladner U.S. Pat. No. '409), plasmids (Cull et al. (1992) *Proc Natl Acad Sci USA* 89:1865-1869) or on phage (Scott and Smith (1990) *Science* 249:386-390); (Devlin (1990) *Science* 249:404-406); (Cwirla et al. (1990) *Proc. Natl. Acad. Sci.* 87:6378-6382); (Felici (1991) *J. Mol. Biol.* 222:301-310); (Ladner supra.).

In one embodiment, an assay is a cell-based assay in which a cell which expresses a NEOKINE receptor on the cell surface is contacted with a test compound and the ability of the test compound to bind to a NEOKINE receptor determined. The cell, for example, can be of mammalian origin or a yeast cell. The NEOKINE receptor can be heterologously expressed or over expressed in a host cell (e.g., a COS cell or fibroblastic cell, for example a HEK293 cell). Alternatively, an assay cell can be selected which endogenously expresses a NEOKINE receptor (e.g., RDC1), for example, a rat pancreatic acinar cell line, AR4-2J, a PC12 pheochromocytoma cell, a SK—N-MC neroblastoma cell, a MES-13 mesangial tumor cell, an astrocyte, or a neutrophil). (Hesen et al. (1998) *Immunogenetics* 47:364-370 and Law and Rosenzweig (1994) *Biochem. Biophys. Res. Commun.* 201:458-465). Yeast cells are also particularly amenable for use in screening assays for G-protein-coupled receptors as described, for example, in Pausch (1997) *TIBTECH* 15:487-494. Determining the ability of the test compound to bind to a NEOKINE receptor can be accomplished, for example, by coupling the test compound with a radioisotope or enzymatic label such that binding of the test compound to the NEOKINE receptor can be determined by detecting the labeled compound in a complex. For example, test compounds can be labeled with $^{125}I$, $^{35}S$, $^{14}C$, or $^3H$, either directly or indirectly, and the radioisotope detected by direct counting of radioemission or by scintillation counting. Alternatively, test compounds can be enzymatically labeled with, for example, horseradish peroxidase, alkaline phosphatase, or luciferase, and the enzymatic label detected by determination of conversion of an appropriate substrate to product.

It is also within the scope of this invention to determine the ability of a test compound to interact with an NEOKINE receptor without the labeling of any of the interactants. For example, a microphysiometer can be used to detect the interaction of a test compound with an NEOKINE receptor without the labeling of either the test compound or the receptor. McConnell, H. M. et al. (1992) *Science* 257:1906-1912. As used herein, a "microphysiometer" (e.g., Cytosensor™) is an analytical instrument that measures the rate at which a cell acidifies its environment using a light-addressable potentiometric sensor (LAPS). Changes in this acidification rate can be used as an indicator of the interaction between ligand and receptor.

In a preferred embodiment, the assay comprises contacting a cell which expresses an NEOKINE receptor on the cell surface with a NEOKINE protein or biologically-active portion thereof and a test compound, and determining the ability of the test compound to modulate binding of the NEOKINE protein or biologically-active portion thereof to the NEOKINE receptor. Determining the ability of the test compound to modulate binding of the NEOKINE protein or biologically-active portion thereof to the NEOKINE receptor can comprise determining the ability of the test compound to preferentially bind to the NEOKINE receptor as compared to the ability of NEOKINE, or a biologically active portion thereof, to bind to the receptor. Alternatively, determining the ability of the test compound to modulate binding of the NEOKINE protein or biologically-active portion thereof to the NEOKINE receptor can comprise determining a change in the binding of the NEOKINE protein or biologically-active portion thereof to the NEOKINE receptor (e.g., a change in the amount of binding in the presence of the test compound as compared to the absence of the test compound).

In another preferred embodiment, the assay comprises contacting a cell which expresses a receptor specific for another chemokine on the cell surface with an NEOKINE protein or biologically-active portion thereof and a test compound, and determining the ability of the test compound to interact with the receptor, wherein determining the ability of the test compound to interact with the receptor comprises determining the ability of the test compound to preferentially bind to the receptor as compared to the ability of the NEOKINE, or a biologically active portion thereof, to bind to the receptor. Alternatively, determining the ability of the test compound to interact with the NEOKINE receptor can comprise determining a change in the binding of the NEOKINE protein or biologically-active portion thereof to the NEOKINE receptor (e.g., a change in the amount of binding).

In another embodiment, an assay is a cell-based assay comprising contacting a cell expressing a NEOKINE target molecule (e.g. a NEOKINE receptor) with a test compound and determining the ability of the test compound to modulate (e.g. stimulate or inhibit) the activity of the NEOKINE target molecule. In yet another embodiment, an assay is a cell-based assay comprising contacting a cell expressing a NEOKINE receptor with a NEOKINE protein or biologically-active portion thereof and a test compound and determining the ability of the test compound to modulate the activity of the NEOKINE target molecule.

Determining the ability of the NEOKINE protein to bind to or interact with an NEOKINE target molecule can be accomplished by one of the methods described above for determining direct binding. The activity of the target molecule can be determined by detecting induction of a cellular second messenger of the target (i.e. intracellular $Ca^{2+}$, diacylglycerol, $IP_3$, etc.), detecting catalytic/enzymatic activity of the target an appropriate substrate, detecting the induction of a reporter gene (comprising an NEOKINE-responsive regulatory element operatively linked to a nucleic acid encoding a detectable marker, e.g., luciferase), or detecting a cellular response, for example, an angiogenic response or an inflammatory response.

In yet another embodiment, an assay of the present invention is a cell-free assay in which an NEOKINE protein or biologically active portion thereof is contacted with a test compound and the ability of the test compound to bind to the NEOKINE protein or biologically active portion thereof is determined. Binding of the test compound to the NEOKINE protein can be determined either directly or indirectly as described above. In a preferred embodiment, the assay includes contacting the NEOKINE protein or biologically active portion thereof with a known compound which binds NEOKINE to form an assay mixture, contacting the assay mixture with a test compound, and determining the ability of the test compound to interact with an NEOKINE protein, wherein determining the ability of the test compound to interact with an NEOKINE protein comprises determining the ability of the test compound to preferentially bind to NEOKINE or biologically active portion thereof as compared to the known compound.

In another embodiment, the assay is a cell-free assay in which an NEOKINE protein or biologically active portion thereof is contacted with a test compound and the ability of the test compound to modulate (e.g., stimulate or inhibit) the activity of the NEOKINE protein or biologically active portion thereof is determined. Determining the ability of the test compound to modulate the activity of an NEOKINE protein can be accomplished, for example, by determining the ability of the NEOKINE protein to bind to an NEOKINE target molecule by one of the methods described above for determining direct binding. Determining the ability of the NEOKINE protein to bind to an NEOKINE target molecule can also be accomplished using a technology such as real-time Biomolecular Interaction Analysis (BIA). Sjolander and Urbaniczky (1991) *Anal. Chem.* 63:2338-2345 and Szabo et al. (1995) *Curr. Opin. Struct. Biol.* 5:699-705. As used herein, "BIA" is a technology for studying biospecific interactions in real time, without labeling any of the interactants (e.g., BIAcore™). Changes in the optical phenomenon of surface plasmon resonance (SPR) can be used as an indication of real-time reactions between biological molecules.

In an alternative embodiment, determining the ability of the test compound to modulate the activity of an NEOKINE protein can be accomplished by determining the ability of the NEOKINE protein to further modulate the activity of a downstream effector (e.g., an intracellular signaling molecule) of an NEOKINE target molecule (e.g., an NEOKINE receptor). For example, the catalytic/enzymatic activity of the effector molecule on an appropriate substrate can be determined as previously described.

In yet another embodiment, the cell-free assay involves contacting an NEOKINE protein or biologically active portion thereof with a known compound which binds the NEOKINE protein to form an assay mixture, contacting the assay mixture with a test compound, and determining the ability of the test compound to interact with the NEOKINE protein, wherein determining the ability of the test compound to interact with the NEOKINE protein comprises determining the ability of the NEOKINE protein to preferentially bind to or modulate the activity of an NEOKINE target molecule.

The assays of the present invention are based at least in part on the discovery that NEOKINE receptor is the previously identified orphan chemokine receptor, RDC1. The nucleic acid sequence of human, murine and canine RDC1 are set forth in SEQ ID NO:129, SEQ ID NO:131 and SEQ ID NO:133, respectively. The amino acid sequences of human, murine and canine RDC1 are set forth in SEQ ID NO:130, SEQ ID NO:132 or SEQ ID NO:134, respectively. Human, murine and canine RDC1 sequences can be further found at Accession Nos. U73141 & U67784, AF000236, and X14048, respectively. Accordingly, in one embodiment, the NEOKINE receptor has the amino acid set forth in any of SEQ ID NO:130, SEQ ID NO:132 or SEQ ID NO:134. In another embodiment, the NEOKINE receptor is selected encoded by a nucleic acid molecule selected from the group consisting of SEQ ID NO:129, SEQ ID NO:131 or SEQ ID NO:133. In another embodiment the NEOKINE receptor is selected from the group consisting of a receptor having an amino acid sequence which is substantially homologous to the amino acid sequence of any of SEQ ID NO:130, SEQ ID NO:132 or SEQ ID NO:134; a receptor which is encoded by an isolated nucleic acid molecule which is substantially homologous to any of SEQ ID NO:129, SEQ ID NO:131 or SEQ ID NO:133; or a receptor which is encoded by an isolated nucleic acid molecule which hybridizes under stringent conditions to a nucleic acid molecule having any of SEQ ID NO:129, SEQ ID NO:131 or SEQ ID NO:133.

The cell-free assays of the present invention are amenable to use of both soluble and/or membrane-bound forms of isolated proteins (e.g. NEOKINE proteins or biologically active portions thereof or NEOKINE receptors). In the case of cell-free assays in which a membrane-bound form an isolated protein is used (e.g., a NEOKINE receptor) it may be desirable to utilize a solubilizing agent such that the membrane-bound form of the isolated protein is maintained in solution. Examples of such solubilizing agents include non-ionic detergents such as n-octylglucoside, n-dodecylglucoside, n-dodecylmaltoside, octanoyl-N-methylglucamide, decanoyl-N-methylglucamide, Triton® X-100, Triton® X-114, Thesit®, Isotridecypoly(ethylene glycol ether)$_n$, 3-[(3-cholamidopropyl)dimethylamminio]-1-propane sulfonate (CHAPS), 3-[(3-cholamidopropyl)dimethylamminio]-2-hydroxy-1-propane sulfonate (CHAPS O), or N-dodecyl=N,N-dimethyl-3-ammonio-1-propane sulfonate.

In more than one embodiment of the above assay methods of the present invention, it may be desirable to immobilize either NEOKINE or its target molecule to facilitate separation of complexed from uncomplexed forms of one or both of the proteins, as well as to accommodate automation of the assay. Binding of a test compound to a NEOKINE protein, or interaction of a NEOKINE protein with a target molecule in the presence and absence of a candidate compound, can be accomplished in any vessel suitable for containing the reactants. Examples of such vessels include microtitre plates, test tubes, and micro-centrifuge tubes. In one embodiment, a fusion protein can be provided which adds a domain that allows one or both of the proteins to be bound to a matrix. For example, glutathione-S-transferase/NEOKINE fusion proteins or glutathione-S-transferase/target fusion proteins can be adsorbed onto glutathione sepharose beads (Sigma Chemical, St. Louis, Mo.) or glutathione derivatized microtitre plates, which are then combined with the test compound or the test compound and either the non-adsorbed target protein or NEOKINE protein, and the mixture incubated under conditions conducive to complex formation (e.g., at physiological conditions for salt and pH). Following incubation, the beads or microtitre plate wells are washed to remove any unbound components, the matrix immobilized in the case of beads, complex determined either directly or indirectly, for example, as described above. Alternatively, the complexes can be dissociated from the matrix, and the level of NEOKINE binding or activity determined using standard techniques.

Other techniques for immobilizing proteins on matrices can also be used in the screening assays of the invention. For example, either a NEOKINE protein or a NEOKINE target molecule can be immobilized utilizing conjugation of biotin and streptavidin. Biotinylated NEOKINE protein or target molecules can be prepared from biotin-NHS(N-hydroxy-succinimide) using techniques well known in the art (e.g., biotinylation kit, Pierce Chemicals, Rockford, Ill.), and immobilized in the wells of streptavidin-coated 96 well plates (Pierce Chemical). Alternatively, antibodies reactive with NEOKINE protein or target molecules but which do not interfere with binding of the NEOKINE protein to its target molecule can be derivatized to the wells of the plate, and unbound target or NEOKINE protein trapped in the wells by antibody conjugation. Methods for detecting such complexes, in addition to those described above for the GST-immobilized complexes, include immunodetection of complexes using antibodies reactive with the NEOKINE protein or target molecule, as well as enzyme-linked assays which rely on detecting an enzymatic activity associated with the NEOKINE protein or target molecule.

In another embodiment, modulators of NEOKINE expression are identified in a method wherein a cell is contacted with a candidate compound and the expression of NEOKINE mRNA or protein in the cell is determined. The level of expression of NEOKINE mRNA or protein in the presence of the candidate compound is compared to the level of expression of NEOKINE mRNA or protein in the absence of the candidate compound. The candidate compound can then be identified as a modulator of NEOKINE expression based on this comparison. For example, when expression of NEOKINE mRNA or protein is greater (statistically significantly greater) in the presence of the candidate compound than in its absence, the candidate compound is identified as a stimulator of NEOKINE mRNA or protein expression. Alternatively, when expression of NEOKINE mRNA or protein is less (statistically significantly less) in the presence of the candidate compound than in its absence, the candidate compound is identified as an inhibitor of NEOKINE mRNA or protein expression. The level of NEOKINE mRNA or protein expression in the cells can be determined by methods described herein for detecting NEOKINE mRNA or protein.

In yet another aspect of the invention, the NEOKINE proteins can be used as "bait proteins" in a two-hybrid assay or three-hybrid assay (see, e.g., U.S. Pat. No. 5,283,317; Zervos et al. (1993) *Cell* 72:223-232; Madura et al. (1993) *J. Biol. Chem.* 268:12046-12054; Bartel et al. (1993) *Biotechniques* 14:920-924; Iwabuchi et al. (1993) *Oncogene* 8:1693-1696; and Brent WO94/10300), to identify other proteins, which bind to or interact with NEOKINE ("NEOKINE-binding proteins" or "NEOKINE-bp") and are involved in NEOKINE activity. Such NEOKINE-binding proteins are also likely to be involved in the propagation of signals by the NEOKINE proteins as, for example, downstream elements of a NEOKINE-mediated signaling pathway. Alternatively, such NEOKINE-binding proteins are likely to be cell-surface molecules associated with non-NEOKINE expressing cells, wherein such NEOKINE-binding proteins are involved in chemoattraction.

The two-hybrid system is based on the modular nature of most transcription factors, which consist of separable DNA-binding and activation domains. Briefly, the assay utilizes two different DNA constructs. In one construct, the gene that codes for a NEOKINE protein is fused to a gene encoding the DNA binding domain of a known transcription factor (e.g., GAL-4). In the other construct, a DNA sequence, from a library of DNA sequences, that encodes an unidentified protein ("prey" or "sample") is fused to a gene that codes for the activation domain of the known transcription factor. If the "bait" and the "prey" proteins are able to interact, in vivo, forming a NEOKINE-dependent complex, the DNA-binding and activation domains of the transcription factor are brought into close proximity. This proximity allows transcription of a reporter gene (e.g., LacZ) which is operably linked to a transcriptional regulatory site responsive to the transcription factor. Expression of the reporter gene can be detected and cell colonies containing the functional transcription factor can be isolated and used to obtain the cloned gene which encodes the protein which interacts with the NEOKINE protein.

This invention further pertains to novel agents identified by the above-described screening assays. Accordingly, it is within the scope of this invention to further use an agent identified as described herein in an appropriate animal model. For example, an agent identified as described herein (e.g., a NEOKINE modulating agent, an antisense NEOKINE nucleic acid molecule, a NEOKINE-specific antibody, or a NEOKINE-binding partner) can be used in an animal model to determine the efficacy, toxicity, or side effects of treatment with such an agent. Alternatively, an agent identified as described herein can be used in an animal model to determine the mechanism of action of such an agent. Furthermore, this invention pertains to uses of novel agents identified by the above-described screening assays for treatments as described herein.

FTHMA-070, Tango85, Tango77, SPOIL, NEOKINE, Tango129 or A259 Detection Assays

Portions or fragments of the cDNA sequences identified herein (and the corresponding complete gene sequences) can be used in numerous ways as polynucleotide reagents. For example, these sequences can be used to: (i) map their respective genes on a chromosome; and, thus, locate gene regions associated with genetic disease; (ii) identify an individual from a minute biological sample (tissue typing); and (iii) aid in forensic identification of a biological sample. These applications are described in the subsections below.

FTHMA-070, Tango85. Tango77, SPOIL, NEOKINE, Tango129 or A259 Chromosome Mapping Once the sequence (or a portion of the sequence) of a gene has been isolated, this sequence can be used to map the location of the gene on a chromosome. Accordingly, FTHMA-070, Tango85, Tango77, SPOIL, NEOKINE, Tango129 or A259 nucleic acid molecules described herein or fragments thereof, can be used to map the location of FTHMA-070, Tango85, Tango77, SPOIL, NEOKINE, Tango129 or A259 genes on a chromosome. The mapping of the FTHMA-070, Tango85, Tango77, SPOIL, NEOKINE, Tango129 or A259 sequences to chromosomes is an important first step in correlating these sequences with genes associated with disease.

Briefly, FTHMA-070, Tango85, Tango77, SPOIL, NEOKINE, Tango129 or A259 genes can be mapped to chromosomes by preparing PCR primers (preferably 15-25 bp in length) from the FTHMA-070, Tango85, Tango77, SPOIL, NEOKINE, Tango129 or A259 sequences. Computer analysis of FTHMA-070, Tango85, Tango77, SPOIL, NEOKINE, Tango129 or A259 sequences can be used to rapidly select primers that do not span more than one exon in the genomic DNA, thus complicating the amplification process. These primers can then be used for PCR screening of somatic cell hybrids containing individual human chromosomes. Only those hybrids containing the human gene corresponding to the FTHMA-070, Tango85, Tango77, SPOIL, NEOKINE, Tango129 or A259 sequences will yield an amplified fragment.

Somatic cell hybrids are prepared by fusing somatic cells from different mammals (e.g., human and mouse cells). As hybrids of human and mouse cells grow and divide, they gradually lose human chromosomes in random order, but retain the mouse chromosomes. By using media in which mouse cells cannot grow, because they lack a particular enzyme, but human cells can, the one human chromosome that contains the gene encoding the needed enzyme, will be retained. By using various media, panels of hybrid cell lines can be established. Each cell line in a panel contains either a single human chromosome or a small number of human chromosomes, and a full set of mouse chromosomes, allowing easy mapping of individual genes to specific human chromosomes. (D'Eustachio et al. (1983) *Science* 220:919-924). Somatic cell hybrids containing only fragments of human chromosomes can also be produced by using human chromosomes with translocations and deletions.

PCR mapping of somatic cell hybrids is a rapid procedure for assigning a particular sequence to a particular chromosome. Three or more sequences can be assigned per day using a single thermal cycler. Using the FTHMA-070, Tango85, Tango77, SPOIL, NEOKINE, Tango129 or A259 sequences to design oligonucleotide primers, sublocalization can be achieved with panels of fragments from specific chromosomes. Other mapping strategies which can similarly be used to map a FTHMA-070, Tango85, Tango77, SPOIL, NEOKINE, Tango 129 or A259 sequence to its chromosome include in situ hybridization (described in Fan et al. (1990) *Proc. Natl. Acad. Sci. USA* 87:6223-27), pre-screening with labeled flow-sorted chromosomes, and pre-selection by hybridization to chromosome specific cDNA libraries.

Fluorescence in situ hybridization (FISH) of a DNA sequence to a metaphase chromosomal spread can further be used to provide a precise chromosomal location in one step. Chromosome spreads can be made using cells whose division has been blocked in metaphase by a chemical like colcemid that disrupts the mitotic spindle. The chromosomes can be treated briefly with trypsin, and then stained with Giemsa. A pattern of light and dark bands develops on each chromosome, so that the chromosomes can be identified individually. The FISH technique can be used with a DNA sequence as short as 500 or 600 bases. However, clones larger than 1,000 bases have a higher likelihood of binding to a unique chromosomal location with sufficient signal intensity for simple detection. Preferably 1,000 bases, and more preferably 2,000 bases will suffice to get good results at a reasonable amount of time. For a review of this technique, see Verma et al., Human Chromosomes: A Manual of Basic Techniques (Pergamon Press, New York, 1988).

Reagents for chromosome mapping can be used individually to mark a single chromosome or a single site on that chromosome, or panels of reagents can be used for marking multiple sites and/or multiple chromosomes. Reagents corresponding to noncoding regions of the genes actually are preferred for mapping purposes. Coding sequences are more likely to be conserved within gene families, thus increasing the chance of cross hybridizations during chromosomal mapping.

Once a sequence has been mapped to a precise chromosomal location, the physical position of the sequence on the chromosome can be correlated with genetic map data. (Such data are found, for example, in V. McKusick, Mendelian Inheritance in Man, available on-line through Johns Hopkins University Welch Medical Library). The relationship between genes and disease, mapped to the same chromosomal region, can then be identified through linkage analysis (co-inheritance of physically adjacent genes), described in, e.g., Egeland et al. (1987) *Nature,* 325:783-787.

Moreover, differences in the DNA sequences between individuals affected and unaffected with a disease associated with the FTHMA-070, Tango85, Tango77, SPOIL, NEOKINE, Tango129 or A259 gene can be determined. If a mutation is observed in some or all of the affected individuals but not in any unaffected individuals, then the mutation is likely to be the causative agent of the particular disease. Comparison of affected and unaffected individuals generally involves first looking for structural alterations in the chromosomes such as deletions or translocations that are visible from chromosome spreads or detectable using PCR based on that DNA sequence. Ultimately, complete sequencing of genes from several individuals can be performed to confirm the presence of a mutation and to distinguish mutations from polymorphisms.

2. FTHMA-070, Tango85, Tango77, SPOIL, NEOKINE, Tango129 or A259 Tissue Typing

The FTHMA-070, Tango85, Tango77, SPOIL, NEOKINE, Tango129 or A259 sequences of the present invention can also be used to identify individuals from minute biological samples. The United States military, for example, is considering the use of restriction fragment length polymorphism (RFLP) for identification of its personnel. In this technique, an individual's genomic DNA is digested with one or more restriction enzymes, and probed on a Southern blot to yield unique bands for identification. This method does not suffer from the current limitations of "Dog Tags" which can be lost, switched, or stolen, making positive identification difficult. The sequences of the present invention are useful as additional DNA markers for RFLP (described in U.S. Pat. No. 5,272,057).

Furthermore, the sequences of the present invention can be used to provide an alternative technique which determines the actual base-by-base DNA sequence of selected portions of an individual's genome. Thus, the FTHMA-070, Tango85, Tango77, SPOIL, NEOKINE, Tango129 or A259 sequences described herein can be used to prepare two PCR primers from the 5' and 3' ends of the sequences. These primers can then be used to amplify an individual's DNA and subsequently sequence it.

Panels of corresponding DNA sequences from individuals, prepared in this manner, can provide unique individual identifications, as each individual will have a unique set of such DNA sequences due to allelic differences. The sequences of the present invention can be used to obtain such identification sequences from individuals and from tissue. The FTHMA-070, Tango85, Tango77, SPOIL, NEOKINE, Tango129 or A259 sequences of the invention uniquely represent portions of the human genome. Allelic variation occurs to some degree in the coding regions of these sequences, and to a greater degree in the noncoding regions. It is estimated that allelic variation between individual humans occurs with a frequency of about once per each 500 bases. Each of the sequences described herein can, to some degree, be used as a standard against which DNA from an individual can be compared for identification purposes. Because greater numbers of polymorphisms occur in the noncoding regions, fewer sequences are necessary to differentiate individuals. The noncoding sequences of SEQ ID NO:53, 57, 71, 89, 101, 16, 112, 115, 137, 145 or 163 can comfortably provide positive individual identification with a panel of perhaps 10 to 1,000 primers which each yield a noncoding amplified sequence of 100 bases. If predicted coding sequences, such as those in SEQ ID NO:55, 59, 73, 76, 80, 91, 103, 106, 117, 139, 146 or 164 are used, a more appropriate number of primers for positive individual identification would be 500-2,000.

If a panel of reagents from FTHMA-070, Tango85, Tango77, SPOIL, NEOKINE, Tango 129 or A259 sequences described herein is used to generate a unique identification database for an individual, those same reagents can later be used to identify tissue from that individual. Using the unique identification database, positive identification of the individual, living or dead, can be made from extremely small tissue samples.

3. Use of Partial FTHMA-070, Tango85, Tango77, SPOIL, NEOKINE, Tango129 or A259 Sequences in Forensic Biology DNA-based identification techniques can also be used in forensic biology. Forensic biology is a scientific field employing genetic typing of biological evidence found at a crime scene as a means for positively identifying, for example, a perpetrator of a crime. To make such an identification, PCR technology can be used to amplify DNA sequences taken from very small biological samples such as tissues, e.g., hair or skin, or body fluids, e.g., blood, saliva, or semen found at a crime scene. The amplified sequence can then be compared to a standard, thereby allowing identification of the origin of the biological sample.

The sequences of the present invention can be used to provide polynucleotide reagents, e.g., PCR primers, targeted to specific loci in the human genome, which can enhance the reliability of DNA-based forensic identifications by, for example, providing another "identification marker" (i.e. another DNA sequence that is unique to a particular individual). As mentioned above, actual base sequence information can be used for identification as an accurate alternative to patterns formed by restriction enzyme generated fragments. Sequences targeted to noncoding regions are particularly appropriate for this use as greater numbers of polymorphisms occur in the noncoding regions, making it easier to differentiate individuals using this technique. Examples of polynucleotide reagents include the FTHMA-070, T85 or A259 sequences or portions thereof, e.g., fragments derived from the noncoding regions having a length of at least 20 or 30 bases.

The sequences of the present invention can be used to provide polynucleotide reagents, e.g., PCR primers, targeted to specific loci in the human genome, which can enhance the reliability of DNA-based forensic identifications by, for example, providing another "identification marker" (i.e. another DNA sequence that is unique to a particular individual). As mentioned above, actual base sequence information can be used for identification as an accurate alternative to patterns formed by restriction enzyme generated fragments. Sequences targeted to noncoding regions of SEQ ID NO:71, SEQ ID NO:89, SEQ ID NO:101, or SEQ ID NO: 104, SEQ ID NO:112, SEQ ID NO:115 are particularly appropriate for this use as greater numbers of polymorphisms occur in the noncoding regions, making it easier to differentiate individuals using this technique. Examples of polynucleotide reagents include the Tango77, SPOIL, NEOKINE or Tango129 nucleotide sequences or portions thereof, e.g., fragments derived from the noncoding regions of SEQ ID NO:71, SEQ ID NO:89, SEQ ID NO:101, or SEQ ID NO:104, SEQ ID NO:112, SEQ ID NO:115 having a length of at least 20 bases, preferably at least 30 bases.

The FTHMA-070, Tango85, Tango77, SPOIL, NEOKINE, Tango129 or A259 sequences described herein can further be used to provide polynucleotide reagents, e.g., labeled or labelable probes which can be used in, for example, an in situ hybridization technique, to identify a specific tissue, e.g., brain tissue. This can be very useful in cases where a forensic pathologist is presented with a tissue of unknown origin. Panels of such FTHMA-070, Tango85, Tango77, SPOIL, NEOKINE, Tango129 or A259 probes can be used to identify tissue by species and/or by organ type.

In a similar fashion, these reagents, e.g., FTHMA-070, Tango85, Tango77, SPOIL, NEOKINE, Tango129 or A259 primers or probes can be used to screen tissue culture for contamination (i.e., screen for the presence of a mixture of different types of cells in a culture).

FTHMA-070, Tango85, Tango77, SPOIL, NEOKINE, Tango129 or A259 Predictive Medicine The present invention also pertains to the field of predictive medicine in which diagnostic assays, prognostic assays, pharmacogenomics, and monitoring clinical trails are used for prognostic (predictive) purposes to thereby treat an individual prophylactically. Accordingly, one aspect of the present invention relates to diagnostic assays for determining FTHMA-070, Tango85, Tango77, SPOIL, NEOKINE, Tango129 or A259 protein and/or nucleic acid expression as well as FTHMA-070, Tango85, Tango77, SPOIL, NEOKINE, Tango129 or A259 activity, in the context of a biological sample (e.g., blood, serum, cells, tissue) to thereby determine whether an individual is afflicted with a disease or disorder, or is at risk of developing a disorder, associated with aberrant FTHMA-070, Tango85, Tango77, SPOIL, NEOKINE, Tango129 or A259 expression or activity. The invention also provides for prognostic (or predictive) assays for determining whether an individual is at risk of developing a disorder associated with FTHMA-070, Tango85, Tango77, SPOIL, NEOKINE, Tango129 or A259 protein, nucleic acid expression or activity. For example, mutations in a FTHMA-070, Tango85, Tango77, SPOIL, NEOKINE, Tango129 or A259 gene can be assayed in a biological sample. Such assays can be used for prognostic or predictive purpose to thereby prophylactically treat an individual prior to the onset of a disorder characterized by or associated with FTHMA-070, Tango85, Tango77, SPOIL, NEOKINE, Tango129 or A259 protein, nucleic acid expression or activity.

Another aspect of the invention provides methods for determining FTHMA-070, Tango85, Tango77, SPOIL, NEOKINE, Tango129 or A259 protein, nucleic acid expression or FTHMA-070, Tango85, Tango77, SPOIL, NEOKINE, Tango129 or A259 activity in an individual to thereby select appropriate therapeutic or prophylactic agents for that individual (referred to herein as "pharmacogenomics"). Pharmacogenomics allows for the selection of agents (e.g., drugs) for therapeutic or prophylactic treatment of an individual based on the genotype of the individual (e.g., the genotype of the individual examined to determine the ability of the individual to respond to a particular agent.)

Yet another aspect of the invention pertains to monitoring the influence of agents (e.g., drugs or other compounds) on the expression or activity of FTHMA-070, Tango85, Tango77, SPOIL, NEOKINE, Tango129 or A259 in clinical trials.

These and other agents are described in further detail in the following sections.

FTHMA-070, Tango85, Tango77, SPOIL, NEOKINE, Tango129 or A259 Diagnostic Assays

An exemplary method for detecting the presence or absence of FTHMA-070, Tango85, Tango77, SPOIL, NEOKINE, Tango129 or A259 in a biological sample involves obtaining a biological sample from a test subject and contacting the biological sample with a compound or an agent capable of detecting FTHMA-070, Tango85, Tango77, SPOIL, NEOKINE, Tango129 or A259 protein or nucleic acid (e.g., mRNA, genotic DNA) that encodes FTHMA-070, Tango85, Tango77, SPOIL, NEOKINE, Tango129 or A259 protein such that the presence of FTHMA-070, Tango85, Tango77, SPOIL, NEOKINE, Tango129 or A259 is detected in the biological sample. A preferred agent for detecting FTHMA-070, Tango85, Tango77, SPOIL, NEOKINE, Tango129 or A259 mRNA or genomic DNA is a labeled nucleic acid probe capable of hybridizing to FTHMA-070, Tango85, Tango77, SPOIL, NEOKINE, Tango129 or A259 mRNA or genomic DNA. The nucleic acid probe can be, for example, a full-length FTHMA-070, Tango85, Tango77, SPOIL, NEOKINE, Tango129 or A259 nucleic acid, such as the nucleic acid of SEQ ID NO:53, 55, 57, 58, 71, 73, 76, 80, 89, 101, 104, 112, 115, 118, 121, 124, 137, 139, 145, 146, 163 or 164, or the DNA insert of the plasmid deposited with ATCC as Accession Number 98751, or a portion thereof, such as an oligonucleotide of at least 15, 30, 50, 100, 250 or 500 nucleotides in length and sufficient to specifically hybridize under stringent conditions to FTHMA-070, Tango85, Tango77, SPOIL, NEOKINE, Tango129 or A259 mRNA or genomic DNA. Other suitable probes for use in the diagnostic assays of the invention are described herein.

A preferred agent for detecting FTHMA-070, Tango85, Tango77, SPOIL, NEOKINE, Tango129 or A259 protein is an antibody capable of binding to FTHMA-070, Tango85, Tango77, SPOIL, NEOKINE, Tango129 or A259 protein, preferably an antibody with a detectable label. Antibodies can be polyclonal, or more preferably, monoclonal. An intact antibody, or a fragment thereof (e.g., Fab or $F(ab')_2$) can be used. The term "labeled", with regard to the probe or antibody, is intended to encompass direct labeling of the probe or antibody by coupling (i.e., physically linking) a detectable substance to the probe or antibody, as well as indirect labeling of the probe or antibody by reactivity with another reagent that is directly labeled. Examples of indirect labeling include detection of a primary antibody using a fluorescently labeled secondary antibody and end-labeling of a DNA probe with biotin such that it can be detected with fluorescently labeled streptavidin. The term "biological sample" is intended to include tissues, cells and biological fluids isolated from a subject, as well as tissues, cells and fluids present within a subject. That is, the detection method of the invention can be used to detect FTHMA-070, Tango85, Tango77, SPOIL, NEOKINE, Tango129 or A259 mRNA, protein, or genomic DNA in a biological sample in vitro as well as in vivo. For example, in vitro techniques for detection of FTHMA-070, Tango85, Tango77, SPOIL, NEOKINE, Tango129 or A259 mRNA include Northern hybridizations and in situ hybridizations. In vitro techniques for detection of FTHMA-070, Tango85, Tango77, SPOIL, NEOKINE, Tango129 or A259 protein include enzyme linked immunosorbent assays (ELISAs), Western blots, immunoprecipitations and immunofluorescence. In vitro techniques for detection of FTHMA-070, Tango85, Tango77, SPOIL, NEOKINE, Tango 129 or A259 genomic DNA include Southern hybridizations. Furthermore, in vivo techniques for detection of FTHMA-070, Tango85, Tango77, SPOIL, NEOKINE, Tango129 or A259 protein include introducing into a subject a labeled anti-FTHMA-070, Tango85, Tango77, SPOIL, NEOKINE, Tango129 or A259 antibody. For example, the antibody can be labeled with a radioactive marker whose presence and location in a subject can be detected by standard imaging techniques.

In one embodiment, the biological sample contains protein molecules from the test subject. Alternatively, the biological sample can contain mRNA molecules from the test subject or genomic DNA molecules from the test subject. A preferred biological sample is a peripheral blood leukocyte sample isolated by conventional means from a subject.

In another embodiment, the methods further involve obtaining a control biological sample from a control subject, contacting the control sample with a compound or agent capable of detecting FTHMA-070, Tango85, Tango77, SPOIL, NEOKINE, Tango129 or A259 protein, mRNA, or genomic DNA, such that the presence of FTHMA-070, Tango85, Tango77, SPOIL, NEOKINE, Tango129 or A259 protein, mRNA or genomic DNA is detected in the biological sample, and comparing the presence of FTHMA-070, Tango85, Tango77, SPOIL, NEOKINE, Tango129 or A259 proteins mRNA or genomic DNA in the control sample with the presence of FTHMA-070, Tango85, Tango77, SPOIL, NEOKINE, Tango129 or A259 protein, mRNA or genomic DNA in the test sample.

The invention also encompasses kits for detecting the presence of FTHMA-070, Tango85, Tango77, SPOIL, NEOKINE, Tango129 or A259 in a biological sample (a test sample). Such kits can be used to determine if a subject is suffering from or is at increased risk of developing a disorder associated with aberrant expression of FTHMA-070, Tango85, Tango77, SPOIL, NEOKINE, Tango129 or A259 (e.g., an immunological disorder or proliferative disorder, e.g., psoriasis or cancer). For example, the kit can comprise a labeled compound or agent capable of detecting FTHMA-070, Tango85, Tango77, SPOIL, NEOKINE, Tango129 or A259 protein or mRNA in a biological sample and means for determining the amount of FTHMA-070, Tango85, Tango77, SPOIL, NEOKINE, Tango129 or A259 in the sample (e.g., an anti-FTHMA-070, Tango85, Tango77, SPOIL, NEOKINE, Tango129 or A259 antibody or an oligonucleotide probe which binds to DNA encoding FTHMA-070, Tango85, Tango77, SPOIL, NEOKINE, Tango129 or A259). Kits may also include instruction for observing that the tested subject is suffering from or is at risk of developing a disorder associated with aberrant expression of FTHMA-070, Tango85, Tango77, SPOIL, NEOKINE, Tango129 or A259 if the amount of FTHMA-070, Tango85, Tango77, SPOIL, NEOKINE, Tango129 or A259 protein or mRNA is above or below a normal level.

For antibody-based kits, the kit may comprise, for example: (1) a first antibody (e.g., attached to a solid support) which binds to FTHMA-070, Tango85, Tango77, SPOIL, NEOKINE, Tango129 or A259 protein; and, optionally, (2) a second, different antibody which binds to FTHMA-070, Tango85, Tango77, SPOIL, NEOKINE, Tango129 or A259 protein or the first antibody and is conjugated to a detectable agent.

For oligonucleotide-based kits, the kit may comprise, for example: (1) a oligonucleotide, e.g., a detectably labelled oligonucleotide, which hybridizes to a FTHMA-070, Tango85, Tango77, SPOIL, NEOKINE, Tango129 or A259 nucleic acid sequence or (2) a pair of primers useful for amplifying a FTHMA-070, Tango85, Tango77, SPOIL, NEOKINE, Tango129 or A259 nucleic acid molecule;

The kit may also comprise, e.g., a buffering agent, a preservative, or a protein stabilizing agent. The kit may also comprise components necessary for detecting the detectable agent (e.g., an enzyme or a substrate). The kit may also contain a control sample or a series of control samples which can be assayed and compared to the test sample contained. Each component of the kit is usually enclosed within an individual container and all of the various containers are within a single package along with instructions for observing whether the tested subject is suffering from or is at risk of developing a disorder associated with aberrant expression of FTHMA-070, Tango85, Tango77, SPOIL, NEOKINE, Tango129 or A259.

FTHMA-070, Tango85, Tango77, SPOIL, NEOKINE. Tango129 or A259 Prognostic Assays

The methods described herein can furthermore be utilized as diagnostic or prognostic assays to identify subjects having or at risk of developing a disease or disorder associated with aberrant FTHMA-070, Tango85, Tango77 or Tango129 expression or activity. For example, the assays described herein, such as the preceding diagnostic assays or the following assays, can be utilized to identify a subject having or at risk of developing a disorder associated with FTHMA-070, Tango85, Tango77 or Tango129 protein, nucleic acid expression or activity such as an immune system disorder. Alternatively, the prognostic assays can be utilized to identify a subject having or at risk for developing such a disease or disorder. Thus, the present invention provides a method in which a test sample is obtained from a subject and FTHMA-070, Tango85, Tango77 or Tango 129 protein or nucleic acid (e.g., mRNA, genomic DNA) is detected, wherein the presence of FTHMA-070, Tango85, Tango77 or Tango129 protein or nucleic acid is diagnostic for a subject having or at risk of developing a disease or disorder associated with aberrant FTHMA-070, Tango85, Tango77 or Tango129 expression or activity. As used herein, a "test sample" refers to a biological sample obtained from a subject of interest. For example, a test sample can be a biological fluid (e.g., serum), cell sample, or tissue.

The diagnostic methods described herein can furthermore be utilized to identify subjects having or at risk of developing a disease or disorder associated with aberrant SPOIL and/or IL-1 expression or activity. For example, the assays described herein, such as the preceding diagnostic assays or the following assays, can be utilized to identify a subject having or at risk of developing a disorder associated with aberrant SPOIL protein, nucleic acid expression or activity and/or characterized by aberrant IL-1 expression or activity such as an inflammatory disorder, an immune disorder, or a differentiative disorder (e.g., a bone metabolism disorder). Alternatively, the prognostic assays can be utilized to identify a subject having or at risk for developing a differentiative or proliferative disease (e.g., leukemia), an inflammatory disease, or an immune disease. Thus, the present invention provides a method for identifying a disease or disorder associated with aberrant SPOIL and/or IL-1 expression or activity in which a test sample is obtained from a subject and SPOIL protein or nucleic acid (e.g., mRNA, genomic DNA) is detected, wherein the presence of SPOIL protein or nucleic acid is diagnostic for a subject having or at risk of developing a disease or disorder characterized aberrant SPOIL and/or IL-1 expression or activity. As used herein, a "test sample" refers to a biological sample obtained from a subject of interest. For example, a test sample can be a biological fluid (e.g., serum), cell sample, or tissue.

The diagnostic methods described herein can furthermore be utilized to identify subjects having or at risk of developing a disease or disorder associated with aberrant NEOKINE expression or activity. For example, the assays described herein, such as the preceding diagnostic assays or the following assays, can be utilized to identify a subject having or at risk of developing a disorder associated with NEOKINE protein, nucleic acid expression or activity such as an inflammatory disorder. Alternatively, the prognostic assays can be utilized to identify a subject having or at risk for developing an inflammatory disorder. Thus, the present invention provides a method for identifying a disease or disorder associated with aberrant NEOKINE expression or activity in which a test sample is obtained from a subject and NEOKINE protein or nucleic acid (e.g., mRNA, genomic DNA) is detected, wherein the presence of NEOKINE protein or nucleic acid is diagnostic for a subject having or at risk of developing a disease or disorder associated with aberrant NEOKINE expression or activity. As used herein, a "test sample" refers to a biological sample obtained from a subject of interest. For example, a test sample can be a biological fluid (e.g., serum), cell sample, or tissue.

The methods described herein can furthermore be utilized as diagnostic or prognostic assays to identify subjects having or at risk of developing a disease or disorder associated with aberrant expression or activity of a A259 polypeptide of the invention. For example, the assays described herein, such as the preceding diagnostic assays or the following assays, can be utilized to identify a subject having or at risk of developing a disorder associated with aberrant expression or activity of a A259 polypeptide of the invention, e.g., an immunologic disorder, e.g., asthma, anaphylaxis, or atopic dermatitis. Alternatively, the prognostic assays can be utilized to identify a subject having or at risk for developing such a disease or disorder. Thus, the present invention provides a method in which a test sample is obtained from a subject and a A259 polypeptide or nucleic acid (e.g., mRNA, genomic DNA) of the invention is detected, wherein the presence of the A259 polypeptide or nucleic acid is diagnostic for a subject having or at risk of developing a disease or disorder associated with aberrant expression or activity of the A259 polypeptide. As used herein, a "test sample" refers to a biological sample obtained from a subject of interest. For example, a test sample can be a biological fluid (e.g., serum), cell sample, or tissue.

Furthermore, the prognostic assays described herein can be used to determine whether a subject can be administered an agent (e.g., an agonist, antagonist, peptidomimetic, protein, peptide, nucleic acid, small molecule, or other drug candidate) to treat a disease or disorder associated with aberrant FTHMA-070, Tango85, Tango77, SPOIL, NEOKINE, Tango 129 or A259 expression or activity. For example, such methods can be used to determine whether a subject can be effectively treated with a specific agent or class of agents (e.g., agents of a type which decrease FTHMA-070, Tango85, Tango77, SPOIL, NEOKINE, Tango129 or A259 activity). Thus, the present invention provides methods for determining whether a subject can be effectively treated with an agent for a disorder associated with aberrant FTHMA-070, Tango85, Tango77, SPOIL, NEOKINE, Tango129 or A259 expression or activity in which a test sample is obtained and FTHMA-070, Tango85, Tango77, SPOIL, NEOKINE, Tango129 or A259 protein or nucleic acid is detected (e.g., wherein the presence of FTHMA-070, Tango85, Tango77, SPOIL, NEOKINE, Tango129 or A259 protein or nucleic acid is diagnostic for a subject that can be administered the agent to treat a disorder associated with aberrant FTHMA-070, Tango85, Tango77, SPOIL, NEOKINE, Tango 129 or A259 expression or activity).

The methods of the invention can also be used to detect genetic lesions or mutations in a FTHMA-070, Tango85, Tango77, SPOIL, NEOKINE, Tango129 or A259 gene, thereby determining if a subject with the lesioned gene is at risk for a disorder characterized by aberrant cell proliferation and/or differentiation. In preferred embodiments, the methods include detecting, in a sample of cells from the subject, the presence or absence of a genetic lesion characterized by at least one of an alteration affecting the integrity of a gene encoding a FTHMA-070, Tango85, Tango77, SPOIL, NEOKINE, Tango129 or A259-protein, or the mis-expression of the FTHMA-070, Tango85, Tango77, SPOIL, NEOKINE, Tango129 or A259 gene. For example, such genetic lesions can be detected by ascertaining the existence of at least one of 1) a deletion of one or more nucleotides from a FTHMA-070, Tango85, Tango77, SPOIL, NEOKINE, Tango129 or A259 gene; 2) an addition of one or more nucleotides to a FTHMA-070, Tango85, Tango77, SPOIL, NEOKINE, Tango129 or A259 gene; 3) a substitution of one or more nucleotides of a FTHMA-070, Tango85, Tango77, SPOIL, NEOKINE, Tango129 or A259 gene, 4) a chromosomal rearrangement of a FTHMA-070, Tango85, Tango77, SPOIL, NEOKINE, Tango129 or A259 gene; 5) an alteration in the level of a messenger RNA transcript of a FTHMA-070, Tango85, Tango77, SPOIL, NEOKINE, Tango129 or A259 gene, 6) aberrant modification of a FTHMA-070, Tango85, Tango77, SPOIL, NEOKINE, Tango129 or A259 gene, such as of the methylation pattern of the genomic DNA, 7) the presence of a non-wild type splicing pattern of a messenger RNA transcript of a FTHMA-070, Tango85, Tango77, SPOIL, NEOKINE, Tango129 or A259 gene, 8) a non-wild type level of a FTHMA-070, Tango85, Tango77, SPOIL, NEOKINE, Tango129 or A259-protein, 9) allelic loss of a FTHMA-070, Tango85, Tango77, SPOIL, NEOKINE, Tango129 or A259 gene, and 10) inappropriate post-translational modification of a FTHMA-070, Tango85, Tango77, SPOIL, NEOKINE, Tango129 or A259-protein. As described herein, there are a large number of assay techniques known in the art which can be used for detecting lesions in a FTHMA-070, Tango85, Tango77, SPOIL, NEOKINE, Tango129 or A259 gene. A preferred biological sample is a peripheral blood leukocyte sample isolated by conventional means from a subject.

In certain embodiments, detection of the lesion involves the use of a probe/primer in a polymerase chain reaction (PCR) (see, e.g., U.S. Pat. Nos. 4,683,195 and 4,683,202), such as anchor PCR or RACE PCR, or, alternatively, in a ligation chain reaction (LCR) (see, e.g., Landegran et al. (1988) *Science* 241:1077-1080; and Nakazawa et al. (1994) *Proc. Natl. Acad. Sci. USA* 91:360-364), the latter of which can be particularly useful for detecting point mutations in the FTHMA-070, Tango85, Tango77, SPOIL, NEOKINE, Tango129 or A259-gene (see Abravaya et al. (1995) *Nucleic Acids Res.* 23:675-682). This method can include the steps of collecting a sample of cells from a patient, isolating nucleic acid (e.g., genomic, mRNA or both) from the cells of the sample, contacting the nucleic acid sample with one or more primers which specifically hybridize to a FTHMA-070, Tango85, Tango77, SPOIL, NEOKINE, Tango129 or A259 gene under conditions such that hybridization and amplification of the FTHMA-070, Tango85, Tango77, SPOIL, NEOKINE, Tango 129 or A259-gene (if present) occurs, and detecting the presence or absence of an amplification product, or detecting the size of the amplification product and comparing the length to a control sample. It is anticipated that PCR and/or LCR may be desirable to use as a preliminary amplification step in conjunction with any of the techniques used for detecting mutations described herein.

Alternative amplification methods include: self sustained sequence replication (Guatelli et al. (1990) *Proc. Natl. Acad. Sci. USA* 87:1874-1878), transcriptional amplification system (Kwoh, et al. (1989) *Proc. Natl. Acad. Sci. USA* 86:1173-1177), Q-Beta Replicase (Lizardi et al. (1988) *Bio/Technology* 6:1197), or any other nucleic acid amplification method, followed by the detection of the amplified molecules using techniques well known to those of skill in the art. These detection schemes are especially useful for the detection of nucleic acid molecules if such molecules are present in very low numbers.

In an alternative embodiment, mutations in a FTHMA-070, Tango85, Tango77, SPOIL, NEOKINE, Tango129 or A259 gene from a sample cell can be identified by alterations in restriction enzyme cleavage patterns. For example, sample and control DNA is isolated, amplified (optionally), digested with one or more restriction endonucleases, and fragment length sizes are determined by gel electrophoresis and compared. Differences in fragment length sizes between sample and control DNA indicates mutations in the sample DNA. Moreover, the use of sequence specific ribozymes (see, e.g., U.S. Pat. No. 5,498,531) can be used to score for the presence of specific mutations by development or loss of a ribozyme cleavage site.

In other embodiments, genetic mutations in FTHMA-070, Tango85, Tango77, SPOIL, NEOKINE, Tango129 or A259 can be identified by hybridizing a sample and control nucleic acids, e.g., DNA or RNA, to high density arrays containing hundreds or thousands of oligonucleotides probes (Cronin et al. (1996) *Human Mutation* 7:244-255; Kozal et al. (1996) *Nature Medicine* 2:753-759). For example, genetic mutations in FTHMA-070, Tango85, Tango77, SPOIL, NEOKINE, Tango129 or A259 can be identified in two-dimensional arrays containing light-generated DNA probes as described in Cronin et al. supra. Briefly, a first hybridization array of probes can be used to scan through long stretches of DNA in a sample and control to identify base changes between the sequences by making linear arrays of sequential overlapping probes. This step allows the identification of point mutations. This step is followed by a second hybridization array that allows the characterization of specific mutations by using smaller, specialized probe arrays complementary to all variants or mutations detected. Each mutation array is composed of parallel probe sets, one complementary to the wild-type gene and the other complementary to the mutant gene.

In yet another embodiment, any of a variety of sequencing reactions known in the art can be used to directly sequence the FTHMA-070, Tango85, Tango77, SPOIL, NEOKINE, Tango129 or A259 gene and detect mutations by comparing the sequence of the sample FTHMA-070, Tango85, Tango77, SPOIL, NEOKINE, Tango129 or A259 with the corresponding wild-type (control) sequence. Examples of sequencing reactions include those based on techniques developed by Maxim and Gilbert ((1977) *Proc. Natl. Acad. Sci. USA* 74:560) or Sanger ((1977) *Proc. Natl. Acad. Sci. USA* 74:5463). It is also contemplated that any of a variety of automated sequencing procedures can be utilized when performing the diagnostic assays ((1995) *Bio/Techniques* 19:448), including sequencing by mass spectrometry (see, e.g., PCT Publication No. WO 94/16101; Cohen et al. (1996) *Adv. Chromatogr.* 36:127-162; and Griffin et al. (1993) *Appl. Biochem. Biotechnol.* 38:147-159).

Other methods for detecting mutations in the FTHMA-070, Tango85, Tango77, SPOIL, NEOKINE, Tango 129 or A259 gene include methods in which protection from cleavage agents is used to detect mismatched bases in RNA/RNA or RNA/DNA heteroduplexes (Myers et al. (1985) *Science* 230:1242). In general, the art technique of "mismatch cleavage" starts by providing heteroduplexes of formed by hybridizing (labeled) RNA or DNA containing the wild-type FTHMA-070, Tango85, Tango77, SPOIL, NEOKINE, Tango129 or A259 sequence with potentially mutant RNA or DNA obtained from a tissue sample. The double-stranded duplexes are treated with an agent which cleaves single-stranded regions of the duplex such as which will exist due to basepair mismatches between the control and sample strands. For instance, RNA/DNA duplexes can be treated with RNase and DNA/DNA hybrids treated with S1 nuclease to enzymatically digesting the mismatched regions. In other embodiments, either DNA/DNA or RNA/DNA duplexes can be treated with hydroxylamine or osmium tetroxide and with piperidine in order to digest mismatched regions. After digestion of the mismatched regions, the resulting material is then separated by size on denaturing polyacrylamide gels to determine the site of mutation. See, e.g., Cotton et al (1988) *Proc. Natl. Acad Sci USA* 85:4397; Saleeba et al (1992) *Methods Enzymol.* 217:286-295. In a preferred embodiment, the control DNA or RNA can be labeled for detection.

In still another embodiment, the mismatch cleavage reaction employs one or more proteins that recognize mismatched base pairs in double-stranded DNA (so called "DNA mismatch repair" enzymes) in defined systems for detecting and mapping point mutations in FTHMA-070, Tango85, Tango77, SPOIL, NEOKINE, Tango129 or A259 cDNAs obtained from samples of cells. For example, the mutY enzyme of *E. coli* cleaves A at G/A mismatches and the thymidine DNA glycosylase from HeLa cells cleaves T at G/T mismatches (Hsu et al. (1994) *Carcinogenesis* 15:1657-1662). According to an exemplary embodiment, a probe based on a FTHMA-070, Tango85, Tango77, SPOIL, NEOKINE, Tango129 or A259 sequence, e.g., a wild-type FTHMA-070, Tango85, Tango77, SPOIL, NEOKINE, Tango129 or A259 sequence, is hybridized to a cDNA or other DNA product from a test cell(s). The duplex is treated with a DNA mismatch repair enzyme, and the cleavage products, if any, can be detected from electrophoresis protocols or the like. See, e.g., U.S. Pat. No. 5,459,039.

In other embodiments, alterations in electrophoretic mobility will be used to identify mutations in FTHMA-070, Tango85, Tango77, SPOIL, NEOKINE, Tango129 or A259 genes. For example, single strand conformation polymorphism (SSCP) may be used to detect differences in electrophoretic mobility between mutant and wild type nucleic acids (Orita et al. (1989) *Proc Natl. Acad. Sci. USA:* 86:2766, see also Cotton (1993) *Mutat. Res.* 285:125-144; and Hayashi (1992) *Genet Anal Tech Appl* 9:73-79). Single-stranded DNA fragments of sample and control FTHMA-070, Tango85, Tango77, SPOIL, NEOKINE, Tango129 or A259 nucleic acids will be denatured and allowed to renature. The secondary structure of single-stranded nucleic acids varies according to sequence, the resulting alteration in electrophoretic mobility enables the detection of even a single base change. The DNA fragments may be labeled or detected with labeled probes. The sensitivity of the assay may be enhanced by using RNA (rather than DNA), in which the secondary structure is more sensitive to a change in sequence. In a preferred embodiment, the subject method utilizes heteroduplex analysis to separate double stranded heteroduplex molecules on the basis of changes in electrophoretic mobility (Keen et al. (1991) *Trends Genet.* 7:5).

In yet another embodiment, the movement of mutant or wild-type fragments in polyacrylamide gels containing a gradient of denaturant is assayed using denaturing gradient gel electrophoresis (DGGE) (Myers et al. (1985) *Nature* 313:495). When DGGE is used as the method of analysis, DNA will be modified to insure that it does not completely denature, for example by adding a GC clamp of approximately 40 bp of high-melting GC-rich DNA by PCR. In a further embodiment, a temperature gradient is used in place of a denaturing gradient to identify differences in the mobility of control and sample DNA (Rosenbaum and Reissner (1987) *Biophys Chem* 265:12753).

Examples of other techniques for detecting point mutations include, but are not limited to, selective oligonucleotide hybridization, selective amplification, or selective primer extension. For example, oligonucleotide primers may be prepared in which the known mutation is placed centrally and then hybridized to target DNA under conditions which permit hybridization only if a perfect match is found (Saiki et al. (1986) *Nature* 324:163); Saiki et al. (1989) *Proc. Natl. Acad. Sci. USA* 86:6230). Such allele specific oligonucleotides are hybridized to PCR amplified target DNA or a number of different mutations when the oligonucleotides are attached to the hybridizing membrane and hybridized with labeled target DNA.

Alternatively, allele specific amplification technology which depends on selective PCR amplification may be used in conjunction with the instant invention. Oligonucleotides used as primers for specific amplification may carry the mutation of interest in the center of the molecule (so that amplification depends on differential hybridization) (Gibbs et al. (1989) *Nucleic Acids Res.* 17:2437-2448) or at the extreme 3' end of one primer where, under appropriate conditions, mismatch can prevent, or reduce polymerase extension (Prossner (1993) *Tibtech* 11:238). In addition, it may be desirable to introduce a novel restriction site in the region of the mutation to create cleavage-based detection (Gasparini et al. (1992) *Mol. Cell. Probes* 6:1). It is anticipated that in certain embodiments amplification may also be performed using Taq ligase for amplification (Barany (1991) *Proc. Natl. Acad. Sci. USA* 88:189). In such cases, ligation will occur only if there is a perfect match at the 3' end of the 5' sequence making it possible to detect the presence of a known mutation at a specific site by looking for the presence or absence of amplification.

The methods described herein may be performed, for example, by utilizing pre-packaged diagnostic kits comprising at least one probe nucleic acid or antibody reagent described herein, which may be conveniently used, e.g., in clinical settings to diagnose patients exhibiting symptoms or family history of a disease or illness involving a FTHMA-070, Tango85, Tango77, SPOIL, NEOKINE, Tango129 or A259 gene.

Furthermore, any cell type or tissue, e.g., chondrocytes, or peripheral blood leukocytes, in which FTHMA-070, Tango85, Tango77, SPOIL, NEOKINE, Tango129 or A259 is expressed may be utilized in the prognostic assays described herein.

FTHMA-070, Tango85, Tango77, SPOIL, NEOKINE, Tango129 or A259 Pharmacogenomics

Agents, or modulators which have a stimulatory or inhibitory effect on FTHMA-070, T85 or A259 activity (e.g., FTHMA-070, T85 or A259 gene expression) as identified by a screening assay described herein can be administered to individuals to treat (prophylactically or therapeutically) disorders (e.g., an immunological disorder) associated with aberrant FTHMA-070, T85 or A259 activity. Agents, or modulators which have a stimulatory or inhibitory effect on Tango-77 activity (e.g., Tango-77 gene expression) as identified by a screening assay described herein can be administered to individuals to treat (prophylactically or therapeutically) disorders (e.g., acute or chronic inflammation and asthma) associated with aberrant Tango-77 activity. The SPOIL molecules of the present invention or SPOIL modulators as identified by a screening assay described herein can be administered to individuals to treat (prophylactically or therapeutically) disorders (e.g., inflammatory or developmental disorders) associated with aberrant SPOIL and/or IL-1 activity. The NEOKINE molecules of the present invention, as well as agents, or modulators which have a stimulatory or inhibitory effect on NEOKINE activity (e.g., NEOKINE gene expression) as identified by a screening assay described herein can be administered to individuals to treat (prophylactically or therapeutically) disorders (e.g., inflammatory disorders) associated with aberrant NEOKINE activity. Agents, or modulators which have a stimulatory or inhibitory effect on T129 activity (e.g., T129 gene expression) as identified by a screening assay described herein can be administered to individuals to treat (prophylactically or therapeutically) disorders (e.g., an immunological disorder) associated with aberrant T129 activity. In conjunction with such treatment, the pharmacogenomics (i.e., the study of the relationship between an individual's genotype and that individual's response to a foreign compound or drug) of the individual may be considered. Differences in metabolism of therapeutics can lead to severe toxicity or therapeutic failure by altering the relation between dose and blood concentration of the pharmacologically active drug. Thus, the pharmacogenomics of the individual permits the selection of effective agents (e.g., drugs) for prophylactic or therapeutic treatments based on a consideration of the individual's genotype. Such pharmacogenomics can further be used to determine appropriate dosages and therapeutic regimens. Accordingly, the activity of FTHMA-070, Tango85, Tango77, SPOIL, NEOKINE, Tango129 or A259 protein, expression of FTHMA-070, Tango85, Tango77, SPOIL, NEOKINE, Tango129 or A259 nucleic acid, or mutation content of FTHMA-070, Tango85, Tango77, SPOIL, NEOKINE, Tango129 or A259 genes in an individual can be determined to thereby select appropriate agent(s) for therapeutic or prophylactic treatment of the individual.

Pharmacogenomics deals with clinically significant hereditary variations in the response to drugs due to altered drug disposition and abnormal action in affected persons. See, e.g., Linder (1997) *Clin. Chem.* 43(2):254-266. In general, two types of pharmacogenetic conditions can be differentiated. Genetic conditions transmitted as a single factor altering the way drugs act on the body (altered drug action) or genetic conditions transmitted as single factors altering the way the body acts on drugs (altered drug metabolism). These pharmacogenetic conditions can occur either as rare defects or as polymorphisms. For example, glucose-6-phosphate dehydrogenase deficiency (G6PD) is a common inherited enzymopathy in which the main clinical complication is haemolysis after ingestion of oxidant drugs (anti-malarials, sulfonamides, analgesics, nitrofurans) and consumption of fava beans.

One pharmacogenomics approach to identifying genes that predict drug response, known as "a genome-wide association", relies primarily on a high-resolution map of the human genome consisting of already known gene-related markers (e.g., a "bi-allelic" gene marker map which consists of 60,000-100,000 polymorphic or variable sites on the human genome, each of which has two variants). Such a high-resolution genetic map can be compared to a map of the genome of each of a statistically significant number of patients taking part in a Phase II/III drug trial to identify markers associated with a particular observed drug response or side effect. Alternatively, such a high resolution map can be generated from a combination of some ten-million known single nucleotide polymorphisms (SNPs) in the human genome. As used herein, a "SNP" is a common alteration that occurs in a single nucleotide base in a stretch of DNA. For example, a SNP may occur once per every 1000 bases of DNA. A SNP may be involved in a disease process, however, the vast majority may not be disease-associated. Given a genetic map based on the occurrence of such SNPs, individuals can be grouped into genetic categories depending on a particular pattern of SNPs in their individual genome. In such a manner, treatment regimens can be tailored to groups of genetically similar individuals, taking into account traits that may be common among such genetically similar individuals.

Alternatively, a method termed the "candidate gene approach", can be utilized to identify genes that predict drug response. According to this method, if a gene that encodes a drug target is known (e.g., a SPOIL or NEOKINE protein or SPOIL or NEOKINE receptor of the present invention), all common variants of that gene can be identified in the population and a particular drug response can be associated with one or more genes.

As an illustrative embodiment, the activity of drug metabolizing enzymes is a major determinant of both the intensity and duration of drug action. The discovery of genetic polymorphisms of drug metabolizing enzymes (e.g., N-acetyltransferase 2 (NAT 2) and cytochrome P450 enzymes CYP2D6 and CYP2C19) has provided an explanation as to why some patients do not obtain the expected drug effects or show exaggerated drug response and serious toxicity after taking the standard and safe dose of a drug. These polymorphisms are expressed in two phenotypes in the population, the extensive metabolizer (EM) and poor metabolizer (PM). The prevalence of PM is different among different populations. For example, the gene coding for CYP2D6 is highly polymorphic and several mutations have been identified in PM, which all lead to the absence of functional CYP2D6. Poor metabolizers of CYP2D6 and CYP2C19 quite frequently experience exaggerated drug response and side effects when they receive standard doses. If a metabolite is the active therapeutic moiety, PM show no therapeutic response, as demonstrated for the analgesic effect of codeine mediated by its CYP2D6-formed metabolite morphine. The other extreme are the so called ultra-rapid metabolizers who do not respond to standard doses. Recently, the molecular basis of ultra-rapid metabolism has been identified to be due to CYP2D6 gene amplification.

Alternatively, a method termed the "gene expression profiling", can be utilized to identify genes that predict drug response. For example, the gene expression of an animal dosed with a drug (e.g., a SPOIL or NEOKINE molecule or SPOIL or NEOKINE modulator of the present invention) indicate whether gene pathways related to toxicity have been turned on.

Information generated from more than one of the above pharmacogenomics approaches can be used to determine appropriate dosage and treatment regimens for prophylactic or therapeutic treatment an individual. This knowledge, when applied to dosing or drug selection, can avoid adverse reactions or therapeutic failure and thus enhance therapeutic or prophylactic efficiency when treating a subject with a SPOIL or NEOKINE molecule or SPOIL or NEOKINE modulator, such as a modulator identified by one of the exemplary screening assays described herein.

Thus, the activity of FTHMA-070, Tango85, Tango77, SPOIL, NEOKINE, Tango129 or A259 protein, expression of FTHMA-070, Tango85, Tango77, SPOIL, NEOKINE, Tango129 or A259 nucleic acid, or mutation content of FTHMA-070, Tango85, Tango77, SPOIL, NEOKINE, Tango129 or A259 genes in an individual can be determined to thereby select appropriate agent(s) for therapeutic or prophylactic treatment of the individual. In addition, pharmacogenetic studies can be used to apply genotyping of polymorphic alleles encoding drug-metabolizing enzymes to the identification of an individual's drug responsiveness phenotype. This knowledge, when applied to dosing or drug selection, can avoid adverse reactions or therapeutic failure and thus enhance therapeutic or prophylactic efficiency when treating a subject with a FTHMA-070, Tango85, Tango77, SPOIL, NEOKINE, Tango129 or A259 modulator, such as a modulator identified by one of the exemplary screening assays described herein.

FTHMA-070, Tango85. Tango77, SPOIL, NEOKINE, Tango129 or A259 Monitoring of Effects During Clinical Trials Monitoring the influence of agents (e.g., drugs, compounds) on the expression or activity of FTHMA-070 or T85 (e.g., the ability to modulate aberrant cell proliferation and/or differentiation) can be applied not only in basic drug screening, but also in clinical trials. For example, the effectiveness of an agent determined by a screening assay as described herein to increase FTHMA-070 or T85 gene expression, protein levels, or upregulate FTHMA-070 or T85 activity, can be monitored in clinical trails of subjects exhibiting decreased FTHMA-070 or T85 gene expression, protein levels, or downregulated FTHMA-070 or T85 activity. Alternatively, the effectiveness of an agent determined by a screening assay to decrease FTHMA-070 or T85 gene expression, protein levels, or downregulated FTHMA-070 or T85 activity, can be monitored in clinical trails of subjects exhibiting increased FTHMA-070 or T85 gene expression, protein levels, or upregulated FTHMA-070 or T85 activity. In such clinical trials, the expression or activity of FTHMA-070 or T85 and, preferably, other genes that have been implicated in, for example, a cellular proliferation disorder can be used as a "read out" or markers of the immune responsiveness of a particular cell.

Monitoring the influence of agents (e.g., drugs, compounds) on the expression or activity of Tango-77 (e.g., the ability to modulate aberrant inflammation) can be applied not only in basic drug screening, but also in clinical trials. For example, the effectiveness of an agent, as determined by a screening assay as described herein, to increase Tango-77 gene expression, increase protein levels, or upregulate Tango-77 activity, can be monitored in clinical trials of subjects exhibiting decreased Tango-77 gene expression, decreased protein levels, or downregulated Tango-77 activity. Alternatively, the effectiveness of an agent, as determined by a screening assay, to decrease Tango-77 gene expression, decrease protein levels, or downregulate Tango-77 activity, can be monitored in clinical trials of subjects exhibiting increased Tango-77 gene expression, increased protein levels, or upregulated Tango-77 activity.

Monitoring the influence of SPOIL agents (e.g., modulatory agents and/or SPOIL proteins) on the expression or activity of SPOIL and/or IL-1 (e.g., modulation of signal transduction, modulation of cell development or differentiation, regulation of cellular proliferation) can be applied not only in basic drug screening, but also in clinical trials. For example, the effectiveness of an agent determined by a screening assay (as described herein) to modulate SPOIL and/or IL-1 expression or activity can be monitored in clinical trails of subjects exhibiting increased SPOIL and/or IL-1 expression or activity and/or decreased SPOIL and/or IL-1 gene expression, protein levels or activity. Alternatively, the effectiveness of an agent determined by a screening assay to increase SPOIL and/or IL-1 expression or activity and/or downregulate SPOIL and/or IL-1 gene expression, protein levels or activity, can be monitored in clinical trails of subjects exhibiting increased SPOIL and/or IL-1 expression or activity and/or decreased SPOIL and/or IL-1 gene expression, protein levels or activity. In such clinical trials, the expression or activity of SPOIL and/or IL-1 and, preferably, other genes that have been implicated in, for example, a proinflammatory disorder, an immune disorder, or a bone metabolism disorder can be used as a "read out" or markers of the phenotype of a particular cell.

Monitoring the influence of agents (e.g., drugs, compounds) on the expression or activity of a NEOKINE protein (e.g., modulation of angiogenesis or of an inflammatory response) an be applied not only in basic drug screening, but also in clinical trials. For example, the effectiveness of an agent determined by a screening assay as described herein to increase NEOKINE gene expression, protein levels, or upregulate NEOKINE activity, can be monitored in clinical trials of subjects exhibiting decreased NEOKINE gene expression, protein levels, or downregulated NEOKINE activity. Alternatively, the effectiveness of an agent determined by a screening assay to decrease NEOKINE gene expression, protein levels, or downregulate NEOKINE activity, can be monitored in clinical trials of subjects exhibiting increased NEOKINE gene expression, protein levels, or upregulated NEOKINE activity. In such clinical trials, the expression or activity of a NEOKINE gene, and preferably, other genes that have been implicated in, for example, an inflammatory disorder can be used as a "read out" or markers of the phenotype of a particular cell.

Monitoring the influence of agents (e.g., drugs, compounds) on the expression or activity of T129 or A259 (e.g., the ability to modulate aberrant cell proliferation and/or differentiation) can be applied not only in basic drug screening, but also in clinical trials. For example, the effectiveness of an agent determined by a screening assay as described herein to increase T129 or A259 gene expression, protein levels, or upregulate T129 or A259 activity, can be monitored in clinical trails of subjects exhibiting decreased T129 or A259 gene expression, protein levels, or downregulated T129 or A259 activity. Alternatively, the effectiveness of an agent determined by a screening assay to decrease T129 or A259 gene expression, protein levels, or downregulated T129 or A259 activity, can be monitored in clinical trails of subjects exhibiting increased T129 or A259 gene expression, protein levels, or upregulated T129 or A259 activity. In such clinical trials, the expression or activity of T129 or A259 and, preferably, other genes that have been implicated in, for example, a cellular proliferation disorder can be used as a "read out" or markers of the immune responsiveness of a particular cell.

For example, and not by way of limitation, genes, including FTHMA-070, Tango85, Tango77, SPOIL, NEOKINE, Tango129 or A259, that are modulated in cells by treatment with an agent (e.g., compound, drug or small molecule) which modulates FTHMA-070, Tango85, Tango77, SPOIL, NEOKINE, Tango129 or A259 activity (e.g., identified in a screening assay as described herein) can be identified. Thus, to study the effect of agents on cellular proliferation disorders, proinflammatory disorders, or developmental or differentiative disorders (e.g., a bone metabolism disorder) for example, in a clinical trial, cells can be isolated and RNA prepared and analyzed for the levels of expression of FTHMA-070, Tango85, Tango77, SPOIL, NEOKINE, Tango129 or A259 and other genes implicated in the disorder. The levels of gene expression (i.e., a gene expression pattern) can be quantified by Northern blot analysis or RT-PCR, as described herein, or alternatively by measuring the amount of protein produced, by one of the methods as described herein, or by measuring the levels of activity of FTHMA-070, Tango85, Tango77, SPOIL, NEOKINE, Tango129 or A259 or other genes. In this way, the gene expression pattern can serve as a marker, indicative of the physiological response of the cells to the agent. Accordingly, this response state may be determined before, and at various points during, treatment of the individual with the agent.

In a preferred embodiment, the present invention provides a method for monitoring the effectiveness of treatment of a subject with an agent (e.g., an agonist, antagonist, peptidomimetic, protein, peptide, nucleic acid, small molecule, or other drug candidate identified by the screening assays described herein) comprising the steps of (i) obtaining a pre-administration sample from a subject prior to administration of the agent; (ii) detecting the level of expression of a FTHMA-070, Tango85, Tango77, SPOIL, NEOKINE, Tango129 or A259 protein, mRNA, or genomic DNA in the preadministration sample; (iii) obtaining one or more post-administration samples from the subject; (iv) detecting the level of expression or activity of the FTHMA-070, Tango85, Tango77, SPOIL, NEOKINE, Tango129 or A259 protein, mRNA, or genomic DNA in the post-administration samples; (v) comparing the level of expression or activity of the FTHMA-070, Tango85, Tango77, SPOIL, NEOKINE, Tango129 or A259 protein, mRNA, or genomic DNA in the pre-administration sample with the FTHMA-070, Tango85, Tango77, SPOIL, NEOKINE, Tango129 or A259 protein, mRNA, or genomic DNA in the post administration sample or samples; and (vi) altering the administration of the agent to the subject accordingly. For example, increased administration of the agent may be desirable to increase the expression or activity of FTHMA-070, Tango85, Tango77, SPOIL, NEOKINE, Tango129 or A259 to higher levels than detected, i.e., to increase the effectiveness of the agent. Alternatively, decreased administration of the agent may be desirable to decrease expression or activity of FTHMA-070, Tango85, Tango77, SPOIL, NEOKINE, Tango129 or A259 to lower levels than detected, i.e., to decrease the effectiveness of the agent.

FTHMA-070, Tango85, Tango77, SPOIL, NEOKINE, Tango129 or A259 Methods of Treatment The present invention provides for both prophylactic and therapeutic methods of treating a subject at risk of (or susceptible to) a disorder or having a disorder associated with aberrant FTHMA-070, Tango85, SPOIL or NEOKINE expression or activity.

The present invention provides for both prophylactic and therapeutic methods of treating a subject at risk of (or susceptible to) developing or having a disorder associated with aberrant Tango-77 expression or activity. Alternatively, disorders associated with aberrant IL-1 production can be treated with Tango-77. Such disorders include acute and chronic inflammation, asthma, some classes of arthritis, autoimmune diabetes, systemic lupus erythematosus and inflammatory bowel disease.

The present invention provides for both prophylactic and therapeutic methods of treating a subject at risk of (or susceptible to) a disorder or having a disorder associated with aberrant T129 expression or activity. Such disorders include immunological disorders, e.g., disorders associated with abnormal lymphoid and/or thymic development, T-cell mediated immune response, T-cell dependent help for B cells, and abnormal humoral B cell activity, and, possibly, disorders of the skeletal muscle.

The present invention provides for both prophylactic and therapeutic methods of treating a subject at risk of (or susceptible to) a disorder or having a disorder associated with aberrant A259 expression or activity of a polypeptide of the invention. For example, disorders characterized by aberrant A259 expression or activity of the polypeptides of the invention include immunologic disorders. In addition, the A259 nucleic acids, polypeptides, and modulators thereof of the invention can be used to treat immunologic diseases and disorders, including but not limited to inflammatory disorders (e.g., atopic dermatitis). A259 polypeptides of the invention can also treat diseases associated and bone and cartilage degenerative diseases and disorders (e.g., arthritis, e.g., rheumatoid arthritis), as well as other disorders described herein.

Prophylactic Methods

In one aspect, the invention provides a method for preventing in a subject, a disease or condition associated with an aberrant FTHMA-070, Tango85, Tango77, SPOIL, NEOKINE, Tango129 or A259 expression or activity, by administering to the subject an agent which modulates FTHMA-070, Tango85, Tango77, SPOIL, NEOKINE, Tango129 or A259 expression or at least one FTHMA-070, Tango85, Tango77, SPOIL, NEOKINE, Tango129 or A259 activity. Subjects at risk for a disease which is caused or contributed to by aberrant FTHMA-070, Tango85, Tango77, SPOIL, NEOKINE, Tango129 or A259 expression or activity can be identified by, for example, any or a combination of diagnostic or prognostic assays as described herein. Administration of a prophylactic agent can occur prior to the manifestation of symptoms characteristic of the FTHMA-070, Tango85, Tango77, SPOIL, NEOKINE, Tango129 or A259 aberrancy, such that a disease or disorder is prevented or, alternatively, delayed in its progression. Depending on the type of FTHMA-070, Tango85, Tango77, SPOIL, NEOKINE, Tango129 or A259 aberrancy, for example, a FTHMA-070, Tango85, Tango77, SPOIL, NEOKINE, Tango129 or A259 agonist or FTHMA-070, Tango85, Tango77, SPOIL, NEOKINE, Tango129 or A259 antagonist agent can be used for treating the subject. The appropriate agent can be determined based on screening assays described herein. For example, an antagonist of an A259 protein may be used to treat an arthropathic disorder, e.g., rheumatoid arthritis. The appropriate agent can be determined based on screening assays described herein.

Therapeutic Methods

Another aspect of the invention pertains to methods of modulating FTHMA-070, Tango85, Tango77, Tango129 or A259 expression or activity for therapeutic purposes. The modulatory method of the invention involves contacting a cell with an agent that modulates one or more of the activities of FTHMA-070, Tango85, Tango77, Tango129 or A259 protein activity associated with the cell. An agent that modulates FTHMA-070, Tango85, Tango77, Tango129 or A259 protein activity can be an agent as described herein, such as a nucleic acid or a protein, a naturally-occurring cognate ligand of a FTHMA-070, Tango85, Tango77, Tango129 or A259 protein, a peptide, a FTHMA-070, Tango85, Tango77, Tango129 or A259 peptidomimetic, or other small molecule. In one embodiment, the agent stimulates one or more of the biological activities of FTHMA-070, Tango85, Tango77, Tango129 or A259 protein. Examples of such stimulatory agents include active FTHMA-070, Tango85, Tango77, Tango129 or A259 protein and a nucleic acid molecule encoding FTHMA-070, Tango85, Tango77, Tango129 or A259 that has been introduced into the cell. In another embodiment, the agent inhibits one or more of the biological activities of FTHMA-070, Tango85, Tango77, Tango129 or A259 protein. Examples of such inhibitory agents include antisense FTHMA-070, Tango85, Tango77, Tango129 or A259 nucleic acid molecules and anti-FTHMA-070, Tango85, Tango77, Tango129 or A259 antibodies. These modulatory methods can be performed in vitro (e.g., by culturing the cell with the agent) or, alternatively, in vivo (e.g., by administering the agent to a subject). As such, the present invention provides methods of treating an individual afflicted with a disease or disorder characterized by aberrant expression or activity of a FTHMA-070, Tango85, Tango77, Tango129 or A259 protein or nucleic acid molecule. In one embodiment, the method involves administering an agent (e.g., an agent identified by a screening assay described herein), or combination of agents that modulates (e.g., upregulates or down-regulates) FTHMA-070, Tango85, Tango77, Tango129 or A259 expression or activity. In another embodiment, the method involves administering a FTHMA-070, Tango85, Tango77, Tango129 or A259 protein or nucleic acid molecule as therapy to compensate for reduced or aberrant FTHMA-070, Tango85, Tango77, Tango 129 or A259 expression or activity.

Another aspect of the invention pertains to methods of modulating SPOIL and/or IL-1 expression or activity for therapeutic purposes. The modulatory method of the invention involves contacting a cell with an agent that modulates one or more of the activities of SPOIL and/or IL-1 associated with the cell or one or more of the activities involved in inflammation, immune response, or bone turnover. An agent that modulates SPOIL and/or IL-1 activity can be an agent as described herein, such as a SPOIL modulator, a nucleic acid encoding a SPOIL protein or a SPOIL protein, a SPOIL peptide, or SPOIL peptidomimetic. In one embodiment, the agent stimulates one or more SPOIL and/or IL-1 protein activity. Examples of such stimulatory agents include SPOIL variants which have SPOIL receptor and/or IL-1 receptor agonist function or a nucleic acid molecule encoding such a SPOIL variant that has been introduced into a cell. In another embodiment, the agent inhibits one or more SPOIL and/or IL-1 activity. Examples of such inhibitory agents include SPOIL proteins and nucleic acid molecules, mutant SPOIL proteins and nucleic acid molecules, antisense SPOIL nucleic acid molecules and SPOIL antibodies. These modulatory methods can be performed in vitro (e.g., by culturing the cell with the agent) or, alternatively, in vivo (e.g., by administering the agent to a subject). As such, the present invention provides methods of treating an individual afflicted with a disease or disorder characterized by aberrant SPOIL and/or IL-1 expression or activity. In one embodiment, the method involves administering a SPOIL agent (e.g., an agent described herein), or combination of agents that modulates (e.g., upregulates or downregulates) SPOIL and/or IL-1 expression or activity. In another embodiment, the method involves administering a SPOIL protein or nucleic acid molecule as therapy to compensate for reduced SPOIL expression or activity.

Another aspect of the invention pertains to methods of modulating NEOKINE or chemokine expression or activity for therapeutic purposes. It has been determined that NEOKINE-1 is strongly expressed in the kidney. This expression of NEOKINE-1 indicates that the NEOKINES have utility in treating kidney inflammation, a major cause of renal failure in chronic and acute renal failure and transplantation. It is known in the art that expression of chemokines in the kidney is not only correlated with inflammation pathology, but also that blocking chemokine action by anti-chemokine antibodies limits or halts progression of the inflammation and resulting tissue damage. The fact that normal human kidney expresses abundant NEOKINE transcript suggests that the kidney makes significant quantities of the protein and that therefore the pro-inflammatory activity low or non-existent. This is consistent with the proposed natural antagonist function of the NEOKINE proteins. Furthermore, signal peptide cleavage prediction on NEOKINE implies that the mature protein will have only two residues before the first cysteine. In an analogous situation, an artificially truncated form of IL-8 with only one residue before the first cysteine instead of the naturally-occurring 6 residues converts the protein from an agonist to an antagonist.

Accordingly, in an exemplary embodiment, the modulatory method of the invention involves contacting a cell with a NEOKINE such that the activity of a chemokine is modulated. Alternatively, the modulatory method of the invention involves contacting a cell with a NEOKINE or agent that modulates one or more of the activities of NEOKINE protein activity associated with the cell. An agent that modulates NEOKINE protein activity can be an agent as described herein, such as a nucleic acid or a protein, a naturally-occurring target molecule of a NEOKINE protein (e.g., a carbohydrate), a NEOKINE antibody, a NEOKINE agonist or antagonist, a peptidomimetic of a NEOKINE agonist or antagonist, or other small molecule. In one embodiment, the agent stimulates one or more NEOKINE activites. Examples of such stimulatory agents include active NEOKINE protein and a nucleic acid molecule encoding NEOKINE that has been introduced into the cell. In another embodiment, the agent inhibits one or more NEOKINE activites. Examples of such inhibitory agents include antisense NEOKINE nucleic acid molecules and anti-NEOKINE antibodies. These modulatory methods can be performed in vitro (e.g., by culturing the cell with the agent) or, alternatively, in vivo (e.g., by administering the agent to a subject). As such, the present invention provides methods of treating an individual afflicted with a disease or disorder characterized by aberrant expression or activity of a NEOKINE protein or nucleic acid molecule. Alternatively, the present invention provides methods of treating an individual afflicted with a disease or disorder characterized by aberrant expression or activity of a chemokine. In one embodiment, the method involves administering an agent (e.g., an agent identified by a screening assay described herein), or combination of agents that modulates (e.g., upregulates or downregulates) NEOKINE expression or activity or the expression or activity of a chemokine. In another embodiment, the method involves administering a NEOKINE protein or nucleic acid molecule as therapy to compensate for reduced or aberrant NEOKINE expression or activity. In another embodiment, the method involves administering a NEOKINE protein or nucleic acid molecule as therapy to compensate for reduced or aberrant chemokine expression or activity.

A preferred embodiment of the present invention involves a method for treatment of a SPOIL or NEOKINE associated disease or disorder which includes the step of administering a therapeutically effective amount of a SPOIL or NEOKINE antibody to a subject. As defined herein, a therapeutically effective amount of antibody (i.e., an effective dosage) ranges from about 0.001 to 30 mg/kg body weight, preferably about 0.01 to 25 mg/kg body weight, more preferably about 0.1 to 20 mg/kg body weight, and even more preferably about 1 to 10 mg/kg, 2 to 9 mg/kg, 3 to 8 mg/kg, 4 to 7 mg/kg, or 5 to 6 mg/kg body weight. The skilled artisan will appreciate that certain factors may influence the dosage required to effectively treat a subject, including but not limited to the severity of the disease or disorder, previous treatments, the general health and/or age of the subject, and other diseases present. Moreover, treatment of a subject with a therapeutically effective amount of an antibody can include a single treatment or, preferably, can include a series of treatments. In a preferred example, a subject is treated with antibody in the range of between about 0.1 to 20 mg/kg body weight, one time per week for between about 1 to 10 weeks, preferably between 2 to 8 weeks, more preferably between about 3 to 7 weeks, and even more preferably for about 4, 5, or 6 weeks. It will also be appreciated that the effective dosage of antibody used for treatment may increase or decrease over the course of a particular treatment. Changes in dosage may result from the results of diagnostic assays as described herein.

Stimulation of FTHMA-070, Tango85, Tango77, Tango129 or A259 activity is desirable in situations in which FTHMA-070, Tango85, Tango77, Tango 129 or A259 is abnormally downregulated and/or in which increased FTHMA-070, Tango85, Tango77, Tango129 or A259 activity is likely to have a beneficial effect. Conversely, inhibition of FTHMA-070, Tango85, Tango77, Tango129 or A259 activity is desirable in situations in which FTHMA-070, Tango85, Tango77, Tango129 or A259 is abnormally upregulated and/or in which decreased FTHMA-070, Tango85, Tango77, Tango129 or A259 activity is likely to have a beneficial effect.

Stimulation of expression or activity is desirable in situations in which SPOIL and/or IL-1 is abnormally downregulated and/or in which increased expression or activity is likely to have a beneficial effect. Likewise, inhibition of expression or activity is desirable in situations in which SPOIL and/or IL-1 is abnormally upregulated and/or in which decreased expression or activity is likely to have a beneficial effect. One example of such a situation is where a subject has a disorder characterized by aberrant cellular differentiation (e.g., a bone resorption disorder). Another example of such a situation is where the subject has a proinflammatory disorder (e.g., sepsis) characterized by an aberrant SPOIL and/or IL-1 response.

Stimulation of NEOKINE activity is desirable in situations in which NEOKINE is abnormally downregulated and/or in which increased NEOKINE activity is likely to have a beneficial effect. For example, stimulation of NEOKINE activity is desirable in situations in which a chemokine is upregulated and/or in which increased NEOKINE activity is likely to have a beneficial effect (e.g., a situation is where a subject has a disorder characterized by aberrant angiogenesis or inflammation, such as kidney inflammation. Likewise, inhibition of NEOKINE activity is desirable in situations in which NEOKINE is abnormally upregulated and/or in which decreased NEOKINE activity is likely to have a beneficial effect.

Delta3 Diagnostic and Prognostic Assays

The present methods provides means for determining if a subject is at risk of developing a disorder characterized by an aberrant Delta3 activity, such as aberrant cell proliferation, degeneration, and/or differentiation resulting for example in a neurodegenerative disease or cancer. The invention also provides methods for determining whether a subject is at risk of developing a disease or disorder associated with one or more specific alleles of a Delta3 gene. In fact, specific Delta3 alleles may be associated with specific diseases or disorders. For example, at least one allele of hDelta3 is likely to be associated with the neurological disease ACCPN. Accordingly, the invention provides methods for determining whether a subject has or is at risk of developing a neurological disease, e.g., ACCPN. In another embodiment, the invention provides methods for determining whether a subject has or is at risk of developing a vascular disorder or a disorder associated with cell fate determination. In one embodiment, the invention comprises determining the identity of the Delta3 allele in a subject and comparing the molecular structure of the Delta3 gene of the subject with the molecular structure of a Delta3 gene from a subject which does not have the neurological disease. Determining the molecular structure can be, e.g., determining the identity of at least one nucleotide, determining the nucleotide composition or determining the methylation pattern of the gene.

In one embodiment, the invention provides a method for determining whether a subject has genetic lesion in a Delta3 gene or a specific allelic variant of a polymorphic region in a Delta3 gene. The specific allele can be a mutant allele. In another embodiment, the invention provides methods for determining whether a subject has an aberrant Delta3 protein, resulting from aberrant post-translational modifications of the protein, such as aberrant phosphorogulation or glycosylation. Also, within the scope of the invention are methods for determining whether a subject has an aberrant expression level of a Delta3 protein, which could be due to a genetic lesion in the Delta3 gene or due to an aberrant level or activity of a protein regulating the expression of a Delta3 gene.

In preferred embodiments, the methods can be characterized as comprising detecting, in a sample of cells from the subject, the presence or absence of a genetic lesion characterized by at least one of (i) an alteration affecting the integrity of a gene encoding a Delta-protein, or (ii) the mis-expression of a Delta3 gene. To illustrate, such genetic lesions can be detected by ascertaining the existence of at least one of (i) a deletion of one or more nucleotides from a Delta3 gene, (ii) an addition of one or more nucleotides to a Delta3 gene, (iii) a substitution of one or more nucleotides of a Delta3 gene, (iv) a gross chromosomal rearrangement of a Delta3 gene, (v) a gross alteration in the level of a messenger RNA transcript of a Delta3 gene, (vi) aberrant modification of a Delta3 gene, such as of the methylation pattern of the genomic DNA, (vii) the presence of a non-wild type splicing pattern of a messenger RNA transcript of a Delta3 gene, (viii) a non-wild type level of a Delta-protein, (ix) allelic loss of a Delta3 gene, and (x) inappropriate post-translational modification of a Delta-protein. As set out below, the present invention provides a large number of assay techniques for detecting lesions in a Delta3 gene, and importantly, provides the ability to discern between different molecular causes underlying Delta-dependent aberrant cell proliferation and/or differentiation.

For determining whether a subject has or is at risk of developing a disease or condition associated with a specific allele of a Delta3 gene, preliminary experiments can be performed to determine the identity of the allele associated with a disease. For example, for determining the identity of the hDelta3 allele associated with ACCPN, one can perform mutation detection studies of the Delta3 gene in populations having a high risk of developing ACCPN. For example, one can perform mutation detection analysis of the genomic DNA from subjects in the French Canadian population in the Charlevoix and Saguenay-Lac St Jean regions of the province of Quebec (Casaubon et al. (1996) *Am. J. Hum. Genet.* 58:28). Such an analysis will reveal the identity of the Delta3 allele or alleles associated with ACCPN. Comparison of the Delta3 allele of a subject with this allele or alleles associated with ACCPN will indicate whether a subject has a Delta3 allele associated with ACCPN and thus whether the subject has or is likely to develop ACCPN. Similarly, mutation detection analysis can also be carried out to determine the identity of Delta3 alles associated with other diseases or conditions.

In an exemplary embodiment, there is provided a nucleic acid composition comprising a (purified) oligonucleotide probe including a region of nucleotide sequence which is capable of hybridizing to a sense or antisense sequence of a Delta3 gene, such as represented by any of SEQ ID NOs: 1, 3, 24, 26, 27, 29, 31, 33, 35, 37, 39, 41, 43 or 45, alleles thereof, naturally-occurring mutants thereof, or 5' or 3' flanking sequences or intronic sequences naturally associated with the subject Delta3 genes or naturally-occurring mutants thereof. The nucleic acid of a cell is rendered accessible for hybridization, the probe is exposed to nucleic acid of the sample, and the hybridization of the probe to the sample nucleic acid is detected. Such techniques can be used to detect lesions at either the genomic or mRNA level, including deletions, substitutions, etc., as well as to determine mRNA transcript levels.

As set out above, one aspect of the present invention relates to diagnostic assays for determining, in the context of cells isolated from a patient, if mutations have arisen in one or more Delta3 genes of the sample cells. The present method provides a method for determining if a subject is at risk for a disorder characterized by aberrant Delta3 activity, e.g., cell proliferation and/or differentiation. In preferred embodiments, the method can be generally characterized as comprising detecting, in a sample of cells from the subject, the presence or absence of a genetic lesion characterized by an alteration affecting the integrity of a gene encoding a Delta protein. To illustrate, such genetic lesions can be detected by ascertaining the existence of at least one of (i) a deletion of one or more nucleotides from a Delta-gene, (ii) an addition of one or more nucleotides to a Delta-gene, (iii) a substitution of one or more nucleotides of a Delta-gene, and (iv) the presence of a non-wild type splicing pattern of a messenger RNA transcript of a Delta-gene. As set out below, the present invention provides a large number of assay techniques for detecting lesions in Delta3 genes, and importantly, provides the ability to discern between different molecular causes underlying Delta-dependent aberrant cell proliferation and/or differentiation.

In certain embodiments, detection of the lesion in a Delta gene or the identity of an allelic variant of a polymorphic region of a Delta gene comprises utilizing the probe/primer in a polymerase chain reaction (PCR) (see, e.g., U.S. Pat. Nos. 4,683,195 and 4,683,202), such as anchor PCR or RACE PCR, or, alternatively, in a ligation chain reaction (LCR) (see, e.g., Landegran et al. (1988) Science 241:1077-1080; and Nakazawa et al. (1994) *PNAS* 91:360-364), the latter of which can be particularly useful for detecting point mutations in the Delta-gene (see Abravaya et al. (1995) Nuc Acid Res 23:675-682). In a merely illustrative embodiment, the method includes the steps of (i) collecting a sample of cells from a patient, (ii) isolating nucleic acid (e.g., genomic, mRNA or both) from the cells of the sample, (iii) contacting the nucleic acid sample with one or more primers which specifically hybridize to a Delta gene under conditions such that hybridization and amplification of the Delta-gene (if present) occurs, and (iv) detecting the presence or absence of an amplification product, or detecting the size of the amplification product and comparing the length to a control sample. It is anticipated that PCR and/or LCR may be desirable to use as a preliminary amplification step in conjunction with any of the techniques used for detecting mutations described herein.

Alternative amplification methods include: self sustained sequence replication (Guatelli, J. C. et al., 1990, Proc. Natl. Acad. Sci. USA 87:1874-1878), transcriptional amplification system (Kwoh, D. Y. et al., 1989, Proc. Natl. Acad. Sci. USA 86:1173-1177), Q-Beta Replicase (Lizardi, P. M. et al., 1988, Bio/Technology 6:1197), or any other nucleic acid amplification method, followed by the detection of the amplified molecules using techniques well known to those of skill in the art. These detection schemes are especially useful for the detection of nucleic acid molecules if such molecules are present in very low numbers.

In a preferred embodiment of the subject assay, mutations in a Delta3 gene or specific alleles of a Delta3 gene from a sample cell are identified by alterations in restriction enzyme cleavage patterns. For example, sample and control DNA is isolated, amplified (optionally), digested with one or more restriction endonucleases, and fragment length sizes are determined by gel electrophoresis. Moreover, the use of sequence specific ribozymes (see, for example, U.S. Pat. No. 5,498,531, incorporated herein by reference in its entirety) can be used to score for the presence of specific mutations by development or loss of a ribozyme cleavage site.

In yet another embodiment, any of a variety of sequencing reactions known in the art can be used to directly sequence the Delta3 gene and detect mutations or allelic variants of polymorphic regions by comparing the sequence of the sample Delta3 with the corresponding wild-type (control) sequence. Exemplary sequencing reactions include those based on techniques developed by Maxim and Gilbert (Proc. Natl. Acad Sci USA (1977) 74:560) or Sanger (Sanger et al (1977) Proc. Nat. Acad. Sci. 74:5463). It is also contemplated that any of a variety of automated sequencing procedures may be utilized when performing the subject assays (Biotechniques (1995) 19:448), including by sequencing by mass spectrometry (see, for example PCT publication WO 94/16101; Cohen et al. (1996) Adv Chromatogr 36:127-162; and Griffin et al. (1993) Appl Biochem Biotechnol 38:147-159). It will be evident to one skilled in the art that, for certain embodiments, the occurrence of only one, two or three of the nucleic acid bases need be determined in the sequencing reaction. For instance, A-tract or the like, e.g., where only one nucleic acid is detected, can be carried out.

In a further embodiment, protection from cleavage agents (such as a nuclease, hydroxylamine or osmium tetroxide and with piperidine) can be used to detect mismatched bases in RNA/RNA or RNA/DNA heteroduplexes (Myers, et al. (1985) Science 230:1242). In general, the art technique of "mismatch cleavage" starts by providing heteroduplexes of formed by hybridizing (labeled) RNA or DNA containing the wild-type Delta3 sequence with potentially mutant RNA or DNA obtained from a tissue sample. The double-stranded duplexes are treated with an agent which cleaves single-stranded regions of the duplex such as which will exist due to basepair mismatches between the control and sample strands. For instance, RNA/DNA duplexes can be treated with RNase and DNA/DNA hybrids treated with S1 nuclease to enzymatically digesting the mismatched regions. In other embodiments, either DNA/DNA or RNA/DNA duplexes can be treated with hydroxylamine or osmium tetroxide and with piperidine in order to digest mismatched regions. After digestion of the mismatched regions, the resulting material is then separated by size on denaturing polyacrylamide gels to determine the site of mutation. See, for example, Cotton et al (1988) Proc. Natl. Acad Sci USA 85:4397; Saleeba et al (1992) Methods Enzymod. 217:286-295. In a preferred embodiment, the control DNA or RNA can be labeled for detection.

In still another embodiment, the mismatch cleavage reaction employs one or more proteins that recognize mismatched base pairs in double-stranded DNA (so called "DNA mismatch repair" enzymes) in defined systems for detecting and mapping point mutations in Delta3 cDNAs obtained from samples of cells. For example, the mutY enzyme of $E.$ $coli$ cleaves A at G/A mismatches and the thymidine DNA glycosylase from HeLa cells cleaves T at G/T mismatches (Hsu et al. (1994) Carcinogenesis 15:1657-1662). According to an exemplary embodiment, a probe based on a Delta3 sequence, e.g., a wild-type Delta3 sequence, is hybridized to a cDNA or other DNA product from a test cell(s). The duplex is treated with a DNA mismatch repair enzyme, and the cleavage products, if any, can be detected from electrophoresis protocols or the like. See, for example, U.S. Pat. No. 5,459,039, incorporated herein by reference in its entirety.

In other embodiments, alterations in electrophoretic mobility will be used to identify mutations in Delta3 genes or for determining the identity of the Delta3 allele. For example, single strand conformation polymorphism (SSCP) may be used to detect differences in electrophoretic mobility between mutant and wild type nucleic acids (Orita et al. (1989) Proc Natl. Acad. Sci. USA 86:2766, see also Cotton (1993) Mutat Res 285:125-144; and Hayashi (1992) Genet Anal Tech Appl 9:73-79). Single-stranded DNA fragments of sample and control Delta3 nucleic acids will be denatured and allowed to renature. The secondary structure of single-stranded nucleic acids varies according to sequence, the resulting alteration in electrophoretic mobility enables the detection of even a single base change. The DNA fragments may be labelled or detected with labelled probes. The sensitivity of the assay may be enhanced by using RNA (rather than DNA), in which the secondary structure is more sensitive to a change in sequence. In a preferred embodiment, the subject method utilizes heteroduplex analysis to separate double stranded heteroduplex molecules on the basis of changes in electrophoretic mobility (Keen et al. (1991) Trends Genet. 7:5).

In yet another embodiment the movement of mutant or wild-type fragments in polyacrylamide gels containing a gradient of denaturant is assayed using denaturing gradient gel electrophoresis (DGGE) (Myers et al (1985) Nature 313:495). When DGGE is used as the method of analysis, DNA will be modified to insure that it does not completely denature, for example by adding a GC clamp of approximately 40 bp of high-melting GC-rich DNA by PCR. In a further embodiment, a temperature gradient is used in place of a denaturing agent gradient to identify differences in the mobility of control and sample DNA (Rosenbaum and Reissner (1987) Biophys Chem 265:12753).

Examples of other techniques for detecting point mutations include, but are not limited to, selective oligonucleotide hybridization, selective amplification, or selective primer extension. For example, oligonucleotide primers may be prepared in which the known mutation is placed centrally and then hybridized to target DNA under conditions which permit hybridization only if a perfect match is found (Saiki et al. (1986) Nature 324:163); Saiki et al (1989) Proc. Natl. Acad. Sci. USA 86:6230). Such allele specific oligonucleotide hybridization techniques may be used to test one mutation per reaction when oligonucleotides are hybridized to PCR amplified target DNA or a number of different mutations when the oligonucleotides are attached to the hybridizing membrane and hybridized with labeled target DNA.

Alternatively, allele specific amplification technology which depends on selective PCR amplification may be used in conjunction with the instant invention. Oligonucleotides used as primers for specific amplification may carry the mutation of interest in the center of the molecule (so that amplification depends on differential hybridization) (Gibbs et al (1989) Nucleic Acids Res. 17:2437-2448) or at the extreme 3' end of one primer where, under appropriate conditions, mismatch can prevent, or reduce polymerase extension (Prossner (1993) Tibtech 11:238. In addition it may be desirable to introduce a novel restriction site in the region of the mutation to create cleavage-based detection (Gasparini et al. (1992) Mol. Cell. Probes 6:1). It is anticipated that in certain embodiments amplification may also be performed using Taq ligase for amplification (Barany (1991) Proc. Natl. Acad; Sci USA 88:189). In such cases, ligation will occur only if there is a perfect match at the 3' end of the 5' sequence making it possible to detect the presence of a known mutation at a specific site by looking for the presence or absence of amplification.

Another embodiment of the invention provides for a nucleic acid composition comprising a (purified) oligonucleotide probe including a region of nucleotide sequence which is capable of hybridizing to a sense or antisense sequence of a Delta-gene, or naturally-occurring mutants thereof, or 5' or 3' flanking sequences or intronic sequences naturally associated with the subject Delta-genes or naturally-occurring mutants thereof. The nucleic acid of a cell is rendered accessible for hybridization, the probe is exposed to nucleic acid of the sample, and the hybridization of the probe to the sample nucleic acid is detected. Such techniques can be used to detect lesions at either the genomic or mRNA level, including deletions, substitutions, etc., as well as to determine mRNA transcript levels. Such oligonucleotide probes can be used for both predictive and therapeutic evaluation of allelic mutations which might be manifest in, for example, a neurodegenerative, neoplastic or hyperplastic disorders (e.g., aberrant cell growth).

The methods described herein may be performed, for example, by utilizing pre-packaged diagnostic kits comprising at least one probe nucleic acid or antibody reagent described herein, which may be conveniently used, e.g., in clinical settings to diagnose patients exhibiting symptoms or family history of a disease or illness involving a Delta3 gene.

Any cell type or tissue, preferably neural or endothelial cells, in which the Delta3 is expressed may be utilized in the diagnostics described below. For example, a subject's bodily fluid (e.g., blood) can be obtained by known techniques (e.g., venipuncture). Alternatively, nucleic acid tests can be performed on dry samples (e.g., hair or skin). Fetal nucleic acid samples can be obtained from maternal blood as described in International Patent Application NO: WO91/07660 to Bianchi. Alternatively, amniocytes or chorionic villi may be obtained for performing prenatal testing, e.g., of ACCPN, which is a disease which is usually fatal in the third decade of life.

Diagnostic procedures may also be performed in situ directly upon tissue sections (fixed and/or frozen) of patient tissue obtained from biopsies or resections, such that no nucleic acid purification is necessary. Nucleic acid reagents may be used as probes and/or primers for such in situ procedures (see, for example, Nuovo, G. J., 1992, PCR in situ hybridization: protocols and applications, Raven Press, NY).

In addition to methods which focus primarily on the detection of one nucleic acid sequence, profiles may also be assessed in such detection schemes. Fingerprint profiles may be generated, for example, by utilizing a differential display procedure, Northern analysis and/or RT-PCR.

Antibodies directed against wild type or mutant Delta3 proteins, which are discussed, above, may also be used in disease diagnostics and prognostics. Such diagnostic methods, may be used to detect abnormalities in the level of Delta3 protein expression, or abnormalities in the structure and/or tissue, cellular, or subcellular location of Delta3 proteins. Structural differences may include, for example, differences in the size, electronegativity, or antigenicity of the mutant Delta3 protein relative to the normal Delta3 protein. Protein from the tissue or cell type to be analyzed may easily be detected or isolated using techniques which are well known to one of skill in the art, including but not limited to western blot analysis. For a detailed explanation of methods for carrying out western blot analysis, see Sambrook et al, 1989, supra, at Chapter 18. The protein detection and isolation methods employed herein may also be such as those described in Harlow and Lane, for example, (Harlow, E. and Lane, D., 1988, "Antibodies: A Laboratory Manual", Cold Spring Harbor Laboratory Press, Cold Spring Harbor, N.Y.).

This can be accomplished, for example, by immunofluorescence techniques employing a fluorescently labeled antibody (see below) coupled with light microscopic, flow cytometric, or fluorimetric detection. The antibodies (or fragments thereof) useful in the present invention may, additionally, be employed histologically, as in immunofluorescence or immunoelectron microscopy, for in situ detection of Delta3 proteins. In situ detection may be accomplished by removing a histological specimen from a patient, and applying thereto a labeled antibody of the present invention. The antibody (or fragment) is preferably applied by overlaying the labeled antibody (or fragment) onto a biological sample. Through the use of such a procedure, it is possible to determine not only the presence of the Delta3 protein, but also its distribution in the examined tissue. Using the present invention, one of ordinary skill will readily perceive that any of a wide variety of histological methods (such as staining procedures) can be modified in order to achieve such in situ detection.

Often a solid phase support or carrier is used as a support capable of binding an antigen or an antibody. Well-known supports or carriers include glass, polystyrene, polypropylene, polyethylene, dextran, nylon, amylases, natural and modified celluloses, polyacrylamides, gabbros, and magnetite. The nature of the carrier can be either soluble to some extent or insoluble for the purposes of the present invention. The support material may have virtually any possible structural configuration so long as the coupled molecule is capable of binding to an antigen or antibody. Thus, the support configuration may be spherical, as in a bead, or cylindrical, as in the inside surface of a test tube, or the external surface of a rod. Alternatively, the surface may be flat such as a sheet, test strip, etc. Preferred supports include polystyrene beads. Those skilled in the art will know many other suitable carriers for binding antibody or antigen, or will be able to ascertain the same by use of routine experimentation.

One means for labeling an anti-Delta3 protein specific antibody is via linkage to an enzyme and use in an enzyme immunoassay (EIA) (Voller, "The Enzyme Linked Immunosorbent Assay (ELISA)", Diagnostic Horizons 2:1-7, 1978, Microbiological Associates Quarterly Publication, Walkersville, Md.; Voller, et al., J. Clin. Pathol. 31:507-520 (1978); Butler, Meth. Enzymol. 73:482-523 (1981); Maggio, (ed.) Enzyme Immunoassay, CRC Press, Boca Raton, Fla., 1980; Ishikawa, et al., (eds.) Enzyme Immunoassay, Kgaku Shoin, Tokyo, 1981). The enzyme which is bound to the antibody will react with an appropriate substrate, preferably a chromogenic substrate, in such a manner as to produce a chemical moiety which can be detected, for example, by spectrophotometric, fluorimetric or by visual means. Enzymes which can be used to detectably label the antibody include, but are not limited to, malate dehydrogenase, staphylococcal nuclease, delta-5-steroid isomerase, yeast alcohol dehydrogenase, alpha-glycerophosphate, dehydrogenase, triose phosphate isomerase, horseradish peroxidase, alkaline phosphatase, asparaginase, glucose oxidase, beta-galactosidase, ribonuclease, urease, catalase, glucose-6-phosphate dehydrogenase, glucoamylase and acetylcholinesterase. The detection can be accomplished by colorimetric methods which employ a chromogenic substrate for the enzyme. Detection may also be accomplished by visual comparison of the extent of enzymatic reaction of a substrate in comparison with similarly prepared standards.

Detection may also be accomplished using any of a variety of other immunoassays. For example, by radioactively labeling the antibodies or antibody fragments, it is possible to detect fingerprint gene wild type or mutant peptides through the use of a radioimmunoassay (RIA) (see, for example, Weintraub, B., Principles of Radioimmunoassays, Seventh Training Course on Radioligand Assay Techniques, The Endocrine Society, March, 1986). The radioactive isotope can be detected by such means as the use of a gamma counter or a scintillation counter or by autoradiography.

It is also possible to label the antibody with a fluorescent compound. When the fluorescently labeled antibody is exposed to light of the proper wave length, its presence can then be detected due to fluorescence. Among the most commonly used fluorescent labeling compounds are fluorescein isothiocyanate, rhodamine, phycoerythrin, phycocyanin, allophycocyanin, o-phthaldehyde and fluorescamine.

The antibody can also be detectably labeled using fluorescence emitting metals such as 152Eu, or others of the lanthanide series. These metals can be attached to the antibody using such metal chelating groups as diethylenetriaminepentacetic acid (DTPA) or ethylenediaminetetraacetic acid (EDTA).

The antibody also can be detectably labeled by coupling it to a chemiluminescent compound. The presence of the chemiluminescent-tagged antibody is then determined by detecting the presence of luminescence that arises during the course of a chemical reaction. Examples of particularly useful chemiluminescent labeling compounds are luminol, isoluminol, theromatic acridinium ester, imidazole, acridinium salt and oxalate ester.

Likewise, a bioluminescent compound may be used to label the antibody of the present invention. Bioluminescence is a type of chemiluminescence found in biological systems in, which a catalytic protein increases the efficiency of the chemiluminescent reaction. The presence of a bioluminescent protein is determined by detecting the presence of luminescence. Important bioluminescent compounds for purposes of labeling are luciferin, luciferase and aequorin.

Moreover, it will be understood that any of the above methods for detecting alterations in a Delta3 gene or gene product can be used to monitor the course of treatment or therapy.

Delta3 Drug Screening Assays

The invention provides for compounds, e.g., therapeutic compounds, for treating diseases or conditions caused by, or contributed to by an abnormal Delta3 activity. The compounds that can be used for this purpose can be any type of compound, including a protein, a peptide, peptidomimetic, small molecule, and nucleic acid. A nucleic acid can be, e.g., a gene, an antisense nucleic acid, a ribozyme, or a triplex molecule. A compound of the invention can be an agonist or an antagonist. A compound can act on a Delta3 gene, e.g., to modulate its expression. A compound can also act on a Delta3 protein, e.g., to modulate signal transduction from the receptor. Accordingly, a compound of the invention can be a compound which binds to Delta3 and induces signal transduction from the receptor, such that, e.g., a Delta3 activity is induced. Alternatively, a compound of the invention can be a compound which inhibits interaction of a Delta3 protein with a toporythmic protein, e.g., Notch. In one embodiment, a compound of the invention which interacts with a Delta protein, which is either an agonist or an antagonist, is a toporythmic protein or other protein interacting with Delta3. In an even more preferred embodiment, the compound is a soluble toporythmic protein or other protein interacting with Delta3. For example, a soluble antagonistic toporythmic protein can be a protein which competes with the wild type toporythmic proteins for binding to Delta3. A soluble agonistic toporythmic protein can be a protein which binds to a Delta3 protein in essentially the same manner as a wild-type toporythmic protein, such as to induce at least one Delta3 activity, e.g., signal transduction from the Delta3 protein. Accordingly, a soluble toporythmic protein can be stimulatory form of a toporythmic protein or an inhibitory form of a toporythmic, depending on whether the particular toporythmic protein stimulates or inhibits a Delta3 activity.

Similarly, a soluble Delta3 protein, e.g., Delta3-Ig, can be used to modulate an activity of a toporythmic protein, e.g., Notch. For example, a soluble Delta3 protein can be a stimulatory form of a Delta3 protein, i.e., a Delta3 protein which is capable of stimulating an activity of a toporythmic protein. In one embodiment, such a protein acts in essentially the same manner as wild-type Delta3. In another embodiment, a soluble Delta3 protein is an inhibitory form of a Delta3 protein, i.e., a Delta3 protein which is capable of inhibiting an activity of a toporythmic protein. For example, such a Delta3 protein could inhibit the interaction of wild-type Delta3 with the toporythmic protein. In a preferred embodiment, an inhibitory form of a Delta3 protein inhibits the interaction of several proteins which normally interact with a toporythmic protein, by, e.g., binding to a site of the toporythmic protein that is also a binding site to various other proteins, e.g., other Delta proteins. Accordingly, a Delta3 therapeutic can generally affect the interaction of various toporythmic proteins with each other. Similarly, based at least in part on the sequence and structural similarities between Delta proteins, a Delta therapeutic, other than a Delta3 therapeutic, can also be used for modulating the interaction between a Delta3 protein and a Delta3 interacting binding molecule.

The compounds of the invention can be identified using various assays depending on the type of compound and activity of the compound that is desired. Set forth below are at least some assays that can be used for identifying Delta3 therapeutics. It is within the skill of the art to design additional assays for identifying Delta therapeutics, e.g., Delta3 therapeutics.

By making available purified and recombinant Delta3 polypeptides, the present invention facilitates the development of assays which can be used to screen for drugs, including Delta3 variants, which are either agonists or antagonists of the normal cellular function of the subject Delta3 polypeptides, or of their role in the pathogenesis of cellular differentiation and/or proliferation and disorders related thereto. In one embodiment, the assay evaluates the ability of a compound to modulate binding between a Delta3 polypeptide and a molecule, be it protein or DNA, that interacts either upstream or downstream of the Delta/Notch signaling pathway. A variety of assay formats will suffice and, in light of the present inventions, will be comprehended by a skilled artisan.

Delta3 Cell-Free Assays

Cell free assays can be used to identify compounds which interact with a Delta3 protein. Such assays are available for testing compounds which are proteins, e.g., toporythmic proteins or variants thereof, as well as for testing compounds which are peptidomimetics, small molecules or nucleic acids. The specific assay used for testing these compounds may vary with the type of compound.

In one embodiment, a compound that interacts with a Delta3 protein is identified by screening, e.g., a library of compounds, for binding to a recombinant or purified Delta3 protein or at least a portion thereof. Such assays can involve labeling one or the two components and measuring the extent of their interaction, by, e.g., determining the level of the one or two labels. In these assays, it may be preferable to attach the Delta3 protein to a solid phase surface. Methods for achieving this are further described infra. In one embodiment, the library of compounds is a library of small molecules. In another embodiment, the library of compounds is a library of Delta3 variants, which can be produced according to methods described infra.

Identification of a compound which inhibits an interaction between a Delta3 protein and a toporythmic protein can also be performed by screening compounds using aggregation assays, as described, e.g., in Fehon et al. (1990) Cell 61:523-534.

In another embodiment, the invention provides methods for identifying compounds which inhibit the interaction of a Delta3 protein with a molecule, e.g., a toporythmic protein or a protein interacting with the cytoplasmic domain of a Delta3 protein. Such methods, which are preferably used in high throughput assays can be performed as follows.

In many drug screening programs which test libraries of compounds and natural extracts, high throughput assays are desirable in order to maximize the number of compounds surveyed in a given period of time. Assays which are performed in cell-free systems, such as may be derived with purified or semi-purified proteins, are often preferred as "primary" screens in that they can be generated to permit rapid development and relatively easy detection of an alteration in a molecular target which is mediated by a test compound. Moreover, the effects of cellular toxicity and/or bioavailability of the test compound can be generally ignored in the in vitro system, the assay instead being focused primarily on the effect of the drug on the molecular target as may be manifest in an alteration of binding affinity with upstream or downstream elements. Accordingly, in an exemplary screening assay of the present invention, the compound of interest is contacted with proteins which may function upstream (including both activators and repressors of its activity) or to proteins or nucleic acids which may function downstream of the Delta3 polypeptide, whether they are positively or negatively regulated by it. For example, a protein functioning upstream of a Delta3 polypeptide can be a compound interacting with the extracellular portion of the Delta3 molecule. A protein functioning downstream of a Delta3 polypeptide can be a protein interacting with the cytoplasmic domain of Delta3 and, e.g., transducing a signal to the nucleus. To the mixture of the compound and the upstream or downstream element is then added a composition containing a Delta3 polypeptide. Detection and quantification of complexes of Delta3 with it's upstream or downstream elements provide a means for determining a compound's efficacy at inhibiting (or potentiating) complex formation between Delta3 and the Delta-binding elements. The efficacy of the compound can be assessed by generating dose response curves from data obtained using various concentrations of the test compound. Moreover, a control assay can also be performed to provide a baseline for comparison. In the control assay, isolated and purified Delta3 polypeptide is added to a composition containing the Delta-binding element, and the formation of a complex is quantitated in the absence of the test compound.

Complex formation between the Delta3 polypeptide and a Delta3 binding element may be detected by a variety of techniques. Modulation of the formation of complexes can be quantitated using, for example, detectably labeled proteins such as radiolabeled, fluorescently labeled, or enzymatically labeled Delta3 polypeptides, by immunoassay, or by chromatographic detection.

Typically, it will be desirable to immobilize either Delta3 or its binding protein to facilitate separation of complexes from uncomplexed forms of one or both of the proteins, as well as to accommodate automation of the assay. Binding of Delta3 to an upstream or downstream element, in the presence and absence of a candidate agent, can be accomplished in any vessel suitable for containing the reactants. Examples include microtitre plates, test tubes, and micro-centrifuge tubes. In one embodiment, a fusion protein can be provided which adds a domain that allows the protein to be bound to a matrix. For example, glutathione-S-transferase/Delta3 (GST/Delta) fusion proteins can be adsorbed onto glutathione sepharose beads (Sigma Chemical, St. Louis, Mo.) or glutathione derivatized microtitre plates, which are then combined with the cell lysates, e.g., an $^{35}$S-labeled, and the test compound, and the mixture incubated under conditions conducive to complex formation, e.g., at physiological conditions for salt and pH, though slightly more stringent conditions may be desired. Following incubation, the beads are washed to remove any unbound label, and the matrix immobilized and radiolabel determined directly (e.g., beads placed in scintilant), or in the supernatant after the complexes are subsequently dissociated. Alternatively, the complexes can be dissociated from the matrix, separated by SDS-PAGE, and the level of Delta-binding protein found in the bead fraction quantitated from the gel using standard electrophoretic techniques such as described in the appended examples.

Other techniques for immobilizing proteins on matrices are also available for use in the subject assay. For instance, either Delta3 or its cognate binding protein can be immobilized utilizing conjugation of biotin and streptavidin. For instance, biotinylated Delta3 molecules can be prepared from biotin-NHS(N-hydroxy-succinimide) using techniques well known in the art (e.g., biotinylation kit, Pierce Chemicals, Rockford, Ill.), and immobilized in the wells of streptavidin-coated 96 well plates (Pierce Chemical). Alternatively, antibodies reactive with Delta3 but which do not interfere with binding of upstream or downstream elements can be derivatized to the wells of the plate, and Delta3 trapped in the wells by antibody conjugation. As above, preparations of a Delta-binding protein and a test compound are incubated in the Delta-presenting wells of the plate, and the amount of complex trapped in the well can be quantitated. Exemplary methods for detecting such complexes, in addition to those described above for the GST-immobilized complexes, include immunodetection of complexes using antibodies reactive with the Delta3 binding element, or which are reactive with Delta3 protein and compete with the binding element; as well as enzyme-linked assays which rely on detecting an enzymatic activity associated with the binding element, either intrinsic or extrinsic activity. In the instance of the latter, the enzyme can be chemically conjugated or provided as a fusion protein with the Delta-BP. To illustrate, the Delta-BP can be chemically cross-linked or genetically fused with horseradish peroxidase, and the amount of polypeptide trapped in the complex can be assessed with a chromogenic substrate of the enzyme, e.g., 3,3'-diamino-benzadine tetrahydrochloride or 4-chloro-1-naphthol. Likewise, a fusion protein comprising the polypeptide and glutathione-S-transferase can be provided, and complex formation quantitated by detecting the GST activity using 1-chloro-2,4-dinitrobenzene (Habig et al (1974) J Biol Chem 249:7130).

For processes which rely on immunodetection for quantitating one of the proteins trapped in the complex, antibodies against the protein, such as anti-Delta3 antibodies, can be used. Alternatively, the protein to be detected in the complex can be "epitope tagged" in the form of a fusion protein which includes, in addition to the Delta3 sequence, a second polypeptide for which antibodies are readily available (e.g., from commercial sources). For instance, the GST fusion proteins described above can also be used for quantification of binding using antibodies against the GST moiety. Other useful epitope tags include myc-epitopes (e.g., see Ellison et al. (1991) J Biol Chem 266:21150-21157) which includes a 10-residue sequence from c-myc, as well as the pFLAG system (International Biotechnologies, Inc.) or the pEZZ-protein A system (Pharmacia, N.J.).

Delta3 Cell Based Assays

In addition to cell-free assays, such as described above, the readily available source of Delta3 proteins provided by the present invention also facilitates the generation of cell-based assays for identifying small molecule agonists/antagonists and the like. For example, cells which are sensitive to bFGF/VEGF or matrigel can be caused to overexpress a recombinant Delta3 protein in the presence and absence of a test agent of interest, with the assay scoring for modulation in Delta3 responses by the target cell mediated by the test agent. As with the cell-free assays, agents which produce a statistically significant change in Delta-dependent responses (either inhibition or potentiation) can be identified. In an illustrative embodiment, the expression or activity of a Delta3 is modulated in embryos or cells and the effects of compounds of interest on the readout of interest (such as tissue differentiation, proliferation, tumorigenesis) are measured. For example, the expression of genes which are up- or down-regulated in response to a Delta-dependent signal cascade can be assayed. In preferred embodiments, the regulatory regions of such genes, e.g., the 5' flanking promoter and enhancer regions, are operably linked to a detectable marker (such as luciferase) which encodes a gene product that can be readily detected.

Exemplary cell lines may include endothelial cells such as MVEC's and bovine aortic endothelial cells (BAEC's); as well as generic mammalian cell lines such as HeLa cells and COS cells, e.g., COS-7 (ATCCO®# CRL-1651). Further, the transgenic animals discussed herein may be used to generate cell lines, containing one or more cell types involved in cardiovascular disease, that can be used as cell culture models for this disorder. While primary cultures derived from the transgenic animals of the invention may be utilized, the generation of continuous cell lines is preferred. For examples of techniques which may be used to derive a continuous cell line from the transgenic animals, see Small et al., 1985, Mol. Cell. Biol. 5:642-648.

In one embodiment, a test compound that modifies a Delta3 activity can be identified by incubating a cell having a Delta3 protein with the test compound and measuring signal transduction from the Delta3 protein. Comparison of the signal transduction in the cells incubated with or without the test compound will reveal whether the test compound is a Delta3 therapeutic. Similarly, a test compound that modifies a Delta3 activity can be identified by incubating a cell having a Delta3 ligand with the test compound, e.g., a Delta3 derived compound, and measuring signal transduction from the Delta3 ligand. Comparison of the signal transduction in the cells incubated with or without the test compound will reveal whether the test compound is a Delta3 therapeutic.

In the event that the Delta3 proteins themselves, or in complexes with other proteins, are capable of binding DNA and/or modifying transcription of a gene, a transcriptional based assay could be used, for example, in which a Delta3 responsive regulatory sequence is operably linked to a detectable marker gene, e.g., a luciferase gene. Similarly, Delta3 therapeutics could also be identified by using an assay in which expression of genes that are modulated upon binding of a Delta3 protein to a Delta3 ligand on a cell is monitored. Genes that are responsive to interaction with a Delta3 protein or Delta3 ligand can be identified according to methods known in the art, e.g., differential hybridization or differential display.

In another embodiment, a silicon-based device, called a microphysiometer, can be used to detect and measure the response of cells having a Delta3 protein to test compounds to identify Delta3 therapeutics. This instrument measures the rate at which cells acidify their environment, which is indicative of cellular growth and/or differentiation (McConnel et al. (1992) Science 257:1906).

Monitoring the influence of compounds on cells may be applied not only in basic drug screening, but also in clinical trials. In such clinical trials, the expression of a panel of genes may be used as a "read out" of a particular drug's therapeutic effect.

In yet another aspect of the invention, the subject Delta3 polypeptides can be used to generate a "two hybrid" assay (see, for example, U.S. Pat. No. 5,283,317; Zervos et al. (1993) Cell 72:223-232; Madura et al. (1993) J Biol Chem 268:12046-12054; Bartel et al. (1993) Biotechniques 14:920-924; Iwabuchi et al. (1993) Oncogene 8:1693-1696; and Brent WO94/10300), for isolating coding sequences for other cellular proteins which bind to or interact with Delta3 ("Delta-binding proteins" or "Delta-bp"), such as Notch, and the like.

Briefly, the two hybrid assay relies on reconstituting in vivo a functional transcriptional activator protein from two separate fusion proteins. In particular, the method makes use of chimeric genes which express hybrid proteins. To illustrate, a first hybrid gene comprises the coding sequence for a DNA-binding domain of a transcriptional activator fused in frame to the coding sequence for a Delta3 polypeptide. The second hybrid protein encodes a transcriptional activation domain fused in frame to a sample gene from a cDNA library. If the bait and sample hybrid proteins are able to interact, e.g., form a Delta-dependent complex, they bring into close proximity the two domains of the transcriptional activator. This proximity is sufficient to cause transcription of a reporter gene which is operably linked to a transcriptional regulatory site responsive to the transcriptional activator, and expression of the reporter gene can be detected and used to score for the interaction of the Delta3 and sample proteins. This system can be used to identify compounds which modify, e.g., inhibit the interaction between a Delta3 protein and another protein, by adding 1 test compound to a cell containing the above-described plasmids. The effect of the test compound on the reporter gene expression and then measured to determine the effect of the test compound on the interaction.

In another embodiment, the invention provides arrays for identifying compounds that can induce apoptosis of cells through a Delta3 protein. Apoptotic arrays are known in the act and are described, e.g., in Grimm et al. (1996) Proc. Natl. Acad. Sci. USA 93:10923.

Delta3 Detection Assays

Portions or fragments of the cDNA sequences identified herein (and the corresponding complete gene sequences) can be used in numerous ways as polynucleotide reagents. For example, these sequences can be used to: (i) map their respective genes on a chromosome and, thus, locate gene regions associated with genetic disease; (ii) identify an individual from a minute biological sample (tissue typing); and (iii) aid in forensic identification of a biological sample. These applications are described in the subsections below.

Delta3 Chromosome Mapping

Once the sequence (or a portion of the sequence) of a gene has been isolated, this sequence can be used to map the location of the gene on a chromosome. Accordingly, nucleic acid molecules described herein or fragments thereof, can be used to map the location of the corresponding genes on a chromosome. The mapping of the sequences to chromosomes is an important first step in correlating these sequences with genes associated with disease.

Briefly, genes can be mapped to chromosomes by preparing PCR primers (preferably 15-25 bp in length) from the sequence of a gene of the invention. Computer analysis of the sequence of a gene of the invention can be used to rapidly select primers that do not span more than one exon in the genomic DNA, thus complicating the amplification process. These primers can then be used for PCR screening of somatic cell hybrids containing individual human chromosomes. Only those hybrids containing the human gene corresponding to the gene sequences will yield an amplified fragment. For a review of this technique, see D'Eustachio et al. ((1983) *Science* 220:919-924).

PCR mapping of somatic cell hybrids is a rapid procedure for assigning a particular sequence to a particular chromosome. Three or more sequences can be assigned per day using a single thermal cycler. Using the nucleic acid sequences of the invention to design oligonucleotide primers, sublocalization can be achieved with panels of fragments from specific chromosomes. Other mapping strategies which can similarly be used to map a gene to its chromosome include in situ hybridization (described in Fan et al. (1990) *Proc. Natl. Acad. Sci. USA* 87:6223-27), pre-screening with labeled flow-sorted chromosomes (CITE), and pre-selection by hybridization to chromosome specific cDNA libraries. Fluorescence in situ hybridization (FISH) of a DNA sequence to a metaphase chromosomal spread can further be used to provide a precise chromosomal location in one step. For a review of this technique, see Verma et al., (Human Chromosomes: A Manual of Basic Techniques (Pergamon Press, New York, 1988)).

Reagents for chromosome mapping can be used individually to mark a single chromosome or a single site on that chromosome, or panels of reagents can be used for marking multiple sites and/or multiple chromosomes. Reagents corresponding to noncoding regions of the genes actually are preferred for mapping purposes. Coding sequences are more likely to be conserved within gene families, thus increasing the chance of cross hybridizations during chromosomal mapping.

Once a sequence has been mapped to a precise chromosomal location, the physical position of the sequence on the chromosome can be correlated with genetic map data. (Such data are found, for example, in V. McKusick, Mendelian Inheritance in Man, available on-line through Johns Hopkins University Welch Medical Library). The relationship between genes and disease, mapped to the same chromosomal region, can then be identified through linkage analysis (co-inheritance of physically adjacent genes), described in, e.g., Egeland et al. (1987) *Nature* 325:783-787.

Moreover, differences in the DNA sequences between individuals affected and unaffected with a disease associated with a gene of the invention can be determined. If a mutation is observed in some or all of the affected individuals but not in any unaffected individuals, then the mutation is likely to be the causative agent of the particular disease. Comparison of affected and unaffected individuals generally involves first looking for structural alterations in the chromosomes such as deletions or translocations that are visible from chromosome spreads or detectable using PCR based on that DNA sequence. Ultimately, complete sequencing of genes from several individuals can be performed to confirm the presence of a mutation and to distinguish mutations from polymorphisms.

Furthermore, the nucleic acid sequences disclosed herein can be used to perform searches against "mapping databases", e.g., BLAST-type search, such that the chromosome position of the gene is identified by sequence homology or identity with known sequence fragments which have been mapped to chromosomes.

A polypeptide and fragments and sequences thereof and antibodies specific thereto can be used to map the location of the gene encoding the polypeptide on a chromosome. This mapping can be carried out by specifically detecting the presence of the polypeptide in members of a panel of somatic cell hybrids between cells of a first species of animal from which the protein originates and cells from a second species of animal and then determining which somatic cell hybrid(s) expresses the polypeptide and noting the chromosome(s) from the first species of animal that it contains. For examples of this technique, see Pajunen et al. (1988) *Cytogenet. Cell Genet.* 47:37-41 and Van Keuren et al. (1986) *Hum. Genet.* 74:34-40. Alternatively, the presence of the polypeptide in the somatic cell hybrids can be determined by assaying an activity or property of the polypeptide, for example, enzymatic activity, as described in Bordelon-Riser et al. (1979) *Somatic Cell Genetics* 5:597-613 and Owerbach et al. (1978) *Proc. Natl. Acad. Sci. USA* 75:5640-5644.

Delta3 Tissue Typing

The nucleic acid sequences of the present invention can also be used to identify individuals from minute biological samples. The United States military, for example, is considering the use of restriction fragment length polymorphism (RFLP) for identification of its personnel. In this technique, an individual's genomic DNA is digested with one or more restriction enzymes, and probed on a Southern blot to yield unique bands for identification. This method does not suffer from the current limitations of "Dog Tags" which can be lost, switched, or stolen, making positive identification difficult. The sequences of the present invention are useful as additional DNA markers for RFLP (described in U.S. Pat. No. 5,272,057).

Furthermore, the sequences of the present invention can be used to provide an alternative technique which determines the actual base-by-base DNA sequence of selected portions of an individual's genome. Thus, the nucleic acid sequences described herein can be used to prepare two PCR primers from the 5' and 3' ends of the sequences. These primers can then be used to amplify an individual's DNA and subsequently sequence it.

Panels of corresponding DNA sequences from individuals, prepared in this manner, can provide unique individual identifications, as each individual will have a unique set of such DNA sequences due to allelic differences. The sequences of the present invention can be used to obtain such identification sequences from individuals and from tissue. The nucleic acid sequences of the invention uniquely represent portions of the human genome. Allelic variation occurs to some degree in the coding regions of these sequences, and to a greater degree in the noncoding regions. It is estimated that allelic variation between individual humans occurs with a frequency of about once per each 500 bases. Each of the sequences described herein can, to some degree, be used as a standard against which DNA from an individual can be compared for identification purposes. Because greater numbers of polymorphisms occur in the noncoding regions, fewer sequences are necessary to differentiate individuals. The noncoding sequences of SEQ ID NO: 1 and 24, can comfortably provide positive individual identification with a panel of perhaps 10 to 1,000 primers which each yield a noncoding amplified sequence of 100 bases. If predicted coding sequences, such as those in SEQ ID NO: 3 and 25 are used, a more appropriate number of primers for positive individual identification would be 500-2,000.

If a panel of reagents from the nucleic acid sequences described herein is used to generate a unique identification database for an individual, those same reagents can later be used to identify tissue from that individual. Using the unique identification database, positive identification of the individual, living or dead, can be made from extremely small tissue samples.

Delta3 Use of Partial Gene Sequences in Forensic Biology

DNA-based identification techniques can also be used in forensic biology. Forensic biology is a scientific field employing genetic typing of biological evidence found at a crime scene as a means for positively identifying, for example, a perpetrator of a crime. To make such an identification, PCR technology can be used to amplify DNA sequences taken from very small biological samples such as tissues, e.g., hair or skin, or body fluids, e.g., blood, saliva, or semen found at a crime scene. The amplified sequence can then be compared to a standard, thereby allowing identification of the origin of the biological sample.

The sequences of the present invention can be used to provide polynucleotide reagents, e.g., PCR primers, targeted to specific loci in the human genome, which can enhance the reliability of DNA-based forensic identifications by, for example, providing another "identification marker" (i.e., another DNA sequence that is unique to a particular individual). As mentioned above, actual base sequence information can be used for identification as an accurate alternative to patterns formed by restriction enzyme generated fragments. Sequences targeted to noncoding regions are particularly appropriate for this use as greater numbers of polymorphisms occur in the noncoding regions, making it easier to differentiate individuals using this technique. Examples of polynucleotide reagents include the nucleic acid sequences of the invention or portions thereof, e.g., fragments derived from noncoding regions having a length of at least 20 or 30 bases.

The nucleic acid sequences described herein can further be used to provide polynucleotide reagents, e.g., labeled or labelable probes which can be used in, for example, an in situ hybridization technique, to identify a specific tissue, e.g., brain tissue. This can be very useful in cases where a forensic pathologist is presented with a tissue of unknown origin. Panels of such probes can be used to identify tissue by species and/or by organ type.

Delta3 Predictive Medicine

The present invention also pertains to the field of predictive medicine in which diagnostic assays, prognostic assays, pharmacogenomics, and monitoring clinical trails are used for prognostic (predictive) purposes to thereby treat an individual prophylactically. Accordingly, one aspect of the present invention relates to diagnostic assays for determining expression of a polypeptide or nucleic acid of the invention and/or activity of a polypeptide of the invention, in the context of a biological sample (e.g., blood, serum, cells, tissue) to thereby determine whether an individual is afflicted with a disease or disorder, or is at risk of developing a disorder, associated with aberrant expression or activity of a polypeptide of the invention. The invention also provides for prognostic (or predictive) assays for determining whether an individual is at risk of developing a disorder associated with aberrant expression or activity of a polypeptide of the invention. For example, mutations in a gene of the invention can be assayed in a biological sample. Such assays can be used for prognostic or predictive purpose to thereby prophylactically treat an individual prior to the onset of a disorder characterized by or associated with aberrant expression or activity of a polypeptide of the invention.

Another aspect of the invention provides methods for expression of a nucleic acid or polypeptide of the invention or activity of a polypeptide of the invention in an individual to thereby select appropriate therapeutic or prophylactic agents for that individual (referred to herein as "pharmacogenomics"). Pharmacogenomics allows for the selection of agents (e.g., drugs) for therapeutic or prophylactic treatment of an individual based on the genotype of the individual (e.g., the genotype of the individual examined to determine the ability of the individual to respond to a particular agent).

Yet another aspect of the invention pertains to monitoring the influence of agents (e.g., drugs or other compounds) on the expression or activity of a polypeptide of the invention in clinical trials. These and other agents are described in further detail in the following sections.

Delta3 Prognostic Assays

The methods described herein can furthermore be utilized as diagnostic or prognostic assays to identify subjects having or at risk of developing a disease or disorder associated with aberrant expression or activity of a polypeptide of the invention. For example, the assays described herein, such as the preceding diagnostic assays or the following assays, can be utilized to identify a subject having or at risk of developing a disorder associated with aberrant expression or activity of a polypeptide of the invention. Alternatively, the prognostic assays can be utilized to identify a subject having or at risk for developing such a disease or disorder. Thus, the present invention provides a method in which a test sample is obtained from a subject and a polypeptide or nucleic acid (e.g., mRNA, genomic DNA) of the invention is detected, wherein the presence of the polypeptide or nucleic acid is diagnostic for a subject having or at risk of developing a disease or disorder associated with aberrant expression or activity of the polypeptide. As used herein, a "test sample" refers to a biological sample obtained from a subject of interest. For example, a test sample can be a biological fluid (e.g., serum), cell sample, or tissue.

Furthermore, the prognostic assays described herein can be used to determine whether a subject can be administered an agent (e.g., an agonist, antagonist, peptidomimetic, protein, peptide, nucleic acid, small molecule, or other drug candidate) to treat a disease or disorder associated with aberrant expression or activity of a polypeptide of the invention. For example, such methods can be used to determine whether a subject can be effectively treated with a specific agent or class of agents (e.g., agents of a type which decrease activity of the polypeptide). Thus, the present invention provides methods for determining whether a subject can be effectively treated with an agent for a disorder associated with aberrant expression or activity of a polypeptide of the invention in which a test sample is obtained and the polypeptide or nucleic acid encoding the polypeptide is detected (e.g., wherein the presence of the polypeptide or nucleic acid is diagnostic for a subject that can be administered the agent to treat a disorder associated with aberrant expression or activity of the polypeptide).

The methods of the invention can also be used to detect genetic lesions or mutations in a gene of the invention, thereby determining if a subject with the lesioned gene is at risk for a disorder characterized aberrant expression or activity of a polypeptide of the invention. In preferred embodiments, the methods include detecting, in a sample of cells from the subject, the presence or absence of a genetic lesion or mutation characterized by at least one of an alteration affecting the integrity of a gene encoding the polypeptide of the invention, or the mis-expression of the gene encoding the polypeptide of the invention. For example, such genetic lesions or mutations can be detected by ascertaining the existence of at least one of: 1) a deletion of one or more nucleotides from the gene; 2) an addition of one or more nucleotides to the gene; 3) a substitution of one or more nucleotides of the gene; 4) a chromosomal rearrangement of the gene; 5) an alteration in the level of a messenger RNA transcript of the gene; 6) an aberrant modification of the gene, such as of the methylation pattern of the genomic DNA; 7) the presence of a non-wild type splicing pattern of a messenger RNA transcript of the gene; 8) a non-wild type level of a the protein encoded by the gene; 9) an allelic loss of the gene; and 10) an inappropriate post-translational modification of the protein encoded by the gene. As described herein, there are a large number of assay techniques known in the art which can be used for detecting lesions in a gene.

In certain embodiments, detection of the lesion involves the use of a probe/primer in a polymerase chain reaction (PCR) (see, e.g., U.S. Pat. Nos. 4,683,195 and 4,683,202), such as anchor PCR or RACE PCR, or, alternatively, in a ligation chain reaction (LCR) (see, e.g., Landegran et al. (1988) Science 241:1077-1080; and Nakazawa et al. (1994) Proc. Natl. Acad. Sci. USA 91:360-364), the latter of which can be particularly useful for detecting point mutations in a gene (see, e.g., Abravaya et al. (1995) Nucleic Acids Res. 23:675-682). This method can include the steps of collecting a sample of cells from a patient, isolating nucleic acid (e.g., genomic, mRNA or both) from the cells of the sample, contacting the nucleic acid sample with one or more primers which specifically hybridize to the selected gene under conditions such that hybridization and amplification of the gene (if present) occurs, and detecting the presence or absence of an amplification product, or detecting the size of the amplification product and comparing the length to a control sample. It is anticipated that PCR and/or LCR may be desirable to use as a preliminary amplification step in conjunction with any of the techniques used for detecting mutations described herein.

Alternative amplification methods include: self sustained sequence replication (Guatelli et al. (1990) Proc. Natl. Acad. Sci. USA 87:1874-1878), transcriptional amplification system (Kwoh, et al. (1989) Proc. Natl. Acad. Sci. USA 86:1173-1177), Q-Beta Replicase (Lizardi et al. (1988) Bio/Technology 6:1197), or any other nucleic acid amplification method, followed by the detection of the amplified molecules using techniques well known to those of skill in the art. These detection schemes are especially useful for the detection of nucleic acid molecules if such molecules are present in very low numbers.

In an alternative embodiment, mutations in a selected gene from a sample cell can be identified by alterations in restriction enzyme cleavage patterns. For example, sample and control DNA is isolated, amplified (optionally), digested with one or more restriction endonucleases, and fragment length sizes are determined by gel electrophoresis and compared. Differences in fragment length sizes between sample and control DNA indicates mutations in the sample DNA. Moreover, the use of sequence specific ribozymes (see, e.g., U.S. Pat. No. 5,498,531) can be used to score for the presence of specific mutations by development or loss of a ribozyme cleavage site.

In other embodiments, genetic mutations can be identified by hybridizing a sample and control nucleic acids, e.g., DNA or RNA, to high density arrays containing hundreds or thousands of oligonucleotides probes (Cronin et al. (1996) Human Mutation 7:244-255; Kozal et al. (1996) Nature Medicine 2:753-759). For example, genetic mutations can be identified in two-dimensional arrays containing light-generated DNA probes as described in Cronin et al. (1996) Human Mutation 7:244-255. Briefly, a first hybridization array of probes can be used to scan through long stretches of DNA in a sample and control to identify base changes between the sequences by making linear arrays of sequential overlapping probes. This step allows the identification of point mutations. This step is followed by a second hybridization array that allows the characterization of specific mutations by using smaller, specialized probe arrays complementary to all variants or mutations detected. Each mutation array is composed of parallel probe sets, one complementary to the wild-type gene and the other complementary to the mutant gene.

In yet another embodiment, any of a variety of sequencing reactions known in the art can be used to directly sequence the selected gene and detect mutations by comparing the sequence of the sample nucleic acids with the corresponding wild-type (control) sequence. Examples of sequencing reactions include those based on techniques developed by Maxim and Gilbert ((1977) Proc. Natl. Acad. Sci. USA 74:560) or Sanger ((1977) Proc. Natl. Acad. Sci. USA 74:5463). It is also contemplated that any of a variety of automated sequencing procedures can be utilized when performing the diagnostic assays ((1995) Bio/Techniques 19:448), including sequencing by mass spectrometry (see, e.g., PCT Publication NO: WO 94/16101; Cohen et al. (1996) Adv. Chromatogr. 36:127-162; and Griffin et al. (1993) Appl. Biochem. Biotechnol. 38:147-159).

Other methods for detecting mutations in a selected gene include methods in which protection from cleavage agents is used to detect mismatched bases in RNA/RNA or RNA/DNA heteroduplexes (Myers et al. (1985) Science 230:1242). In general, the technique of mismatch cleavage entails providing heteroduplexes formed by hybridizing (labeled) RNA or DNA containing the wild-type sequence with potentially mutant RNA or DNA obtained from a tissue sample. The double-stranded duplexes are treated with an agent which cleaves single-stranded regions of the duplex such as which will exist due to basepair mismatches between the control and sample strands. RNA/DNA duplexes can be treated with RNase to digest mismatched regions, and DNA/DNA hybrids can be treated with S1 nuclease to digest mismatched regions.

In other embodiments, either DNA/DNA or RNA/DNA duplexes can be treated with hydroxylamine or osmium tetroxide and with piperidine in order to digest mismatched regions. After digestion of the mismatched regions, the resulting material is then separated by size on denaturing polyacrylamide gels to determine the site of mutation. See, e.g., Cotton et al. (1988) Proc. Natl. Acad. Sci. USA 85:4397; Saleeba et al. (1992) Methods Enzymol. 217:286-295. In a preferred embodiment, the control DNA or RNA can be labeled for detection.

In still another embodiment, the mismatch cleavage reaction employs one or more proteins that recognize mismatched base pairs in double-stranded DNA (so called "DNA mismatch repair enzymes") in defined systems for detecting and mapping point mutations in cDNAs obtained from samples of cells. For example, the mutY enzyme of E. coli cleaves A at G/A mismatches and the thymidine DNA glycosylase from HeLa cells cleaves T at G/T mismatches (Hsu et al. (1994) Carcinogenesis 15:1657-1662). According to an exemplary embodiment, a probe based on a selected sequence, e.g., a wild-type sequence, is hybridized to a cDNA or other DNA product from a test cell(s). The duplex is treated with a DNA mismatch repair enzyme, and the cleavage products, if any, can be detected from electrophoresis protocols or the like. See, e.g., U.S. Pat. No. 5,459,039.

In other embodiments, alterations in electrophoretic mobility will be used to identify mutations in genes. For example, single strand conformation polymorphism (SSCP) may be used to detect differences in electrophoretic mobility between mutant and wild type nucleic acids (Orita et al. (1989) *Proc. Natl. Acad. Sci. USA* 86:2766; see also Cotton (1993) *Mutat. Res.* 285:125-144; Hayashi (1992) *Genet. Anal. Tech. Appl.* 9:73-79). Single-stranded DNA fragments of sample and control nucleic acids will be denatured and allowed to renature. The secondary structure of single-stranded nucleic acids varies according to sequence, and the resulting alteration in electrophoretic mobility enables the detection of even a single base change. The DNA fragments may be labeled or detected with labeled probes. The sensitivity of the assay may be enhanced by using RNA (rather than DNA), in which the secondary structure is more sensitive to a change in sequence. In a preferred embodiment, the subject method utilizes heteroduplex analysis to separate double stranded heteroduplex molecules on the basis of changes in electrophoretic mobility (Keen et al. (1991) *Trends Genet.* 7:5).

In yet another embodiment, the movement of mutant or wild-type fragments in polyacrylamide gels containing a gradient of denaturant is assayed using denaturing gradient gel electrophoresis (DGGE) (Myers et al. (1985) *Nature* 313:495). When DGGE is used as the method of analysis, DNA will be modified to insure that it does not completely denature, for example by adding a GC clamp of approximately 40 bp of high-melting GC-rich DNA by PCR. In a further embodiment, a temperature gradient is used in place of a denaturing gradient to identify differences in the mobility of control and sample DNA (Rosenbaum and Reissner (1987) *Biophys. Chem.* 265:12753).

Examples of other techniques for detecting point mutations include, but are not limited to, selective oligonucleotide hybridization, selective amplification, or selective primer extension. For example, oligonucleotide primers may be prepared in which the known mutation is placed centrally and then hybridized to target DNA under conditions which permit hybridization only if a perfect match is found (Saiki et al. (1986) *Nature* 324:163); Saiki et al. (1989) *Proc. Natl. Acad. Sci. USA* 86:6230). Such allele specific oligonucleotides are hybridized to PCR amplified target DNA or a number of different mutations when the oligonucleotides are attached to the hybridizing membrane and hybridized with labeled target DNA.

Alternatively, allele specific amplification technology which depends on selective PCR amplification may be used in conjunction with the instant invention. Oligonucleotides used as primers for specific amplification may carry the mutation of interest in the center of the molecule (so that amplification depends on differential hybridization) (Gibbs et al. (1989) *Nucleic Acids Res.* 17:2437-2448) or at the extreme 3' end of one primer where, under appropriate conditions, mismatch can prevent or reduce polymerase extension (Prossner (1993) *Tibtech* 11:238). In addition, it may be desirable to introduce a novel restriction site in the region of the mutation to create cleavage-based detection (Gasparini et al. (1992) *Mol. Cell. Probes* 6:1). It is anticipated that in certain embodiments amplification may also be performed using Taq ligase for amplification (Barany (1991) *Proc. Natl. Acad. Sci. USA* 88:189). In such cases, ligation will occur only if there is a perfect match at the 3' end of the 5' sequence making it possible to detect the presence of a known mutation at a specific site by looking for the presence or absence of amplification.

The methods described herein may be performed, for example, by utilizing pre-packaged diagnostic kits comprising at least one probe nucleic acid or antibody reagent described herein, which may be conveniently used, e.g., in clinical settings to diagnose patients exhibiting symptoms or family history of a disease or illness involving a gene encoding a polypeptide of the invention. Furthermore, any cell type or tissue, preferably peripheral blood leukocytes, in which the polypeptide of the invention is expressed may be utilized in the prognostic assays described herein.

Delta3 Pharmacogenomics

Agents, or modulators which have a stimulatory or inhibitory effect on activity or expression of a polypeptide of the invention as identified by a screening assay described herein can be administered to individuals to treat (prophylactically or therapeutically) disorders associated with aberrant activity of the polypeptide. In conjunction with such treatment, the pharmacogenomics (i.e., the study of the relationship between an individual's genotype and that individual's response to a foreign compound or drug) of the individual may be considered. Differences in metabolism of therapeutics can lead to severe toxicity or therapeutic failure by altering the relation between dose and blood concentration of the pharmacologically active drug. Thus, the pharmacogenomics of the individual permits the selection of effective agents (e.g., drugs) for prophylactic or therapeutic treatments based on a consideration of the individual's genotype. Such pharmacogenomics can further be used to determine appropriate dosages and therapeutic regimens. Accordingly, the activity of a polypeptide of the invention, expression of a nucleic acid of the invention, or mutation content of a gene of the invention in an individual can be determined to thereby select appropriate agent(s) for therapeutic or prophylactic treatment of the individual.

Pharmacogenomics deals with clinically significant hereditary variations in the response to drugs due to altered drug disposition and abnormal action in affected persons. See, e.g., Linder (1997) *Clin. Chem.* 43(2):254-266. In general, two types of pharmacogenetic conditions can be differentiated. Genetic conditions transmitted as a single factor altering the way drugs act on the body are referred to as "altered drug action." Genetic conditions transmitted as single factors altering the way the body acts on drugs are referred to as "altered drug metabolism". These pharmacogenetic conditions can occur either as rare defects or as polymorphisms. For example, glucose-6-phosphate dehydrogenase deficiency (G6PD) is a common inherited enzymopathy in which the main clinical complication is haemolysis after ingestion of oxidant drugs (anti-malarials, sulfonamides, analgesics, nitrofurans) and consumption of fava beans.

As an illustrative embodiment, the activity of drug metabolizing enzymes is a major determinant of both the intensity and duration of drug action. The discovery of genetic polymorphisms of drug metabolizing enzymes (e.g., N-acetyl-transferase 2 (NAT 2) and cytochrome P450 enzymes CYP2D6 and CYP2C19) has provided an explanation as to why some patients do not obtain the expected drug effects or show exaggerated drug response and serious toxicity after taking the standard and safe dose of a drug. These polymorphisms are expressed in two phenotypes in the population, the extensive metabolizer (EM) and poor metabolizer (PM). The prevalence of PM is different among different populations. For example, the gene coding for CYP2D6 is highly polymorphic and several mutations have been identified in PM, which all lead to the absence of functional CYP2D6. Poor metabolizers of CYP2D6 and CYP2C19 quite frequently experience exaggerated drug response and side effects when they receive standard doses. If a metabolite is the active therapeutic moiety, a PM will show no therapeutic response, as demonstrated for the analgesic effect of codeine mediated by its CYP2D6-formed metabolite morphine. The other extreme are the so called ultra-rapid metabolizers who do not respond to standard doses. Recently, the molecular basis of ultra-rapid metabolism has been identified to be due to CYP2D6 gene amplification.

Thus, the activity of a polypeptide of the invention, expression of a nucleic acid encoding the polypeptide, or mutation content of a gene encoding the polypeptide in an individual can be determined to thereby select appropriate agent(s) for therapeutic or prophylactic treatment of the individual. In addition, pharmacogenetic studies can be used to apply genotyping of polymorphic alleles encoding drug-metabolizing enzymes to the identification of an individual's drug responsiveness phenotype. This knowledge, when applied to dosing or drug selection, can avoid adverse reactions or therapeutic failure and thus enhance therapeutic or prophylactic efficiency when treating a subject with a modulator of activity or expression of the polypeptide, such as a modulator identified by one of the exemplary screening assays described herein.

Delta3 Monitoring of Effects During Clinical Trials

Monitoring the influence of agents (e.g., drugs, compounds) on the expression or activity of a polypeptide of the invention (e.g., the ability to modulate aberrant cell proliferation chemotaxis, and/or differentiation) can be applied not only in basic drug screening, but also in clinical trials. For example, the effectiveness of an agent, as determined by a screening assay as described herein, to increase gene expression, protein levels or protein activity, can be monitored in clinical trials of subjects exhibiting decreased gene expression, protein levels, or protein activity. Alternatively, the effectiveness of an agent, as determined by a screening assay, to decrease gene expression, protein levels or protein activity, can be monitored in clinical trials of subjects exhibiting increased gene expression, protein levels, or protein activity. In such clinical trials, expression or activity of a polypeptide of the invention and preferably, that of other polypeptide that have been implicated in for example, a cellular proliferation disorder, can be used as a marker of the immune responsiveness of a particular cell.

For example, and not by way of limitation, genes, including those of the invention, that are modulated in cells by treatment with an agent (e.g., compound, drug or small molecule) which modulates activity or expression of a polypeptide of the invention (e.g., as identified in a screening assay described herein) can be identified. Thus, to study the effect of agents on cellular proliferation disorders, for example, in a clinical trial, cells can be isolated and RNA prepared and analyzed for the levels of expression of a gene of the invention and other genes implicated in the disorder. The levels of gene expression (i.e., a gene expression pattern) can be quantified by Northern blot analysis or RT-PCR, as described herein, or alternatively by measuring the amount of protein produced, by one of the methods as described herein, or by measuring the levels of activity of a gene of the invention or other genes. In this way, the gene expression pattern can serve as a marker, indicative of the physiological response of the cells to the agent. Accordingly, this response state may be determined before, and at various points during, treatment of the individual with the agent.

In a preferred embodiment, the present invention provides a method for monitoring the effectiveness of treatment of a subject with an agent (e.g., an agonist, antagonist, peptidomimetic, protein, peptide, nucleic acid, small molecule, or other drug candidate identified by the screening assays described herein) comprising the steps of (i) obtaining a pre-administration sample from a subject prior to administration of the agent; (ii) detecting the level of the polypeptide or nucleic acid of the invention in the preadministration sample; (iii) obtaining one or more post-administration samples from the subject; (iv) detecting the level the of the polypeptide or nucleic acid of the invention in the post-administration samples; (v) comparing the level of the polypeptide or nucleic acid of the invention in the pre-administration sample with the level of the polypeptide or nucleic acid of the invention in the post-administration sample or samples; and (vi) altering the administration of the agent to the subject accordingly. For example, increased administration of the agent may be desirable to increase the expression or activity of the polypeptide to higher levels than detected, i.e., to increase the effectiveness of the agent. Alternatively, decreased administration of the agent may be desirable to decrease expression or activity of the polypeptide to lower levels than detected, i.e., to decrease the effectiveness of the agent.

Delta3 Transgenic animals

These systems may be used in a variety of applications. For example, the cell- and animal-based model systems may be used to further characterize Delta3 genes and proteins. In addition, such assays may be utilized as part of screening strategies designed to identify compounds which are capable of ameliorating disease symptoms. Thus, the animal- and cell-based models may be used to identify drugs, pharmaceuticals, therapies and interventions which may be effective in treating disease.

Delta3 Animal-based systems

One aspect of the present invention concerns transgenic animals which are comprised of cells (of that animal) which contain a transgene of the present invention and which preferably (though optionally) express an exogenous Delta3 protein in one or more cells in the animal. A Delta3 transgene can encode the wild-type form of the protein, or can encode homologs thereof, including both alleles of Delta3 genes, agonists and antagonists, as well as antisense constructs. In preferred embodiments, the expression of the transgene is restricted to specific subsets of cells, tissues or developmental stages utilizing, for example, cis-acting sequences that control expression in the desired pattern. In the present invention, such mosaic expression of a Delta3 protein can be essential for many forms of lineage analysis and can additionally provide a means to assess the effects of, for example, lack of Delta3 expression which might grossly alter development in small patches of tissue within an otherwise normal embryo. In a preferred embodiment, the invention provides transgenic mice having an allele of hDelta3 gene which is associated with ACCPN and the mouse can be used, e.g., to determine the effect of this specific hDelta3 allele. Toward this and, tissue-specific regulatory sequences and conditional regulatory sequences can be used to control expression of the transgene in certain spatial patterns. Moreover, temporal patterns of expression can be provided by, for example, conditional recombination systems or prokaryotic transcriptional regulatory sequences.

Genetic techniques which allow for the expression of transgenes can be regulated via site-specific genetic manipulation in vivo are known to those skilled in the art. For instance, genetic systems are available which allow for the regulated expression of a recombinase that catalyzes the genetic recombination a target sequence. As used herein, the phrase "target sequence" refers to a nucleotide sequence that is genetically recombined by a recombinase. The target sequence is flanked by recombinase recognition sequences and is generally either excised or inverted in cells expressing recombinase activity. Recombinase catalyzed recombination events can be designed such that recombination of the target sequence results in either the activation or repression of expression of one of the subject Delta3 proteins. For example, excision of a target sequence which interferes with the expression of a recombinant Delta3 gene, such as one which encodes an antagonistic homolog or an antisense transcript, can be designed to activate expression of that gene. This interference with expression of the protein can result from a variety of mechanisms, such as spatial separation of the Delta3 gene from the promoter element or an internal stop codon. Moreover, the transgene can be made wherein the coding sequence of the gene is flanked by recombinase recognition sequences and is initially transfected into cells in a 3' to 5' orientation with respect to the promoter element. In such an instance, inversion of the target sequence will reorient the subject gene by placing the 5' end of the coding sequence in an orientation with respect to the promoter element which allow for promoter driven transcriptional activation.

The transgenic animals of the present invention all include within a plurality of their cells a transgene of the present invention, which transgene alters the phenotype of the "host cell" with respect to regulation of cell growth, death and/or differentiation. Since it is possible to produce transgenic organisms of the invention utilizing one or more of the transgene constructs described herein, a general description will be given of the production of transgenic organisms by referring generally to exogenous genetic material. This general description can be adapted by those skilled in the art in order to incorporate specific transgene sequences into organisms utilizing the methods and materials described below.

In an illustrative embodiment, either the cre/loxP recombinase system of bacteriophage P1 (Lakso et al. (1992) PNAS 89:6232-6236; Orban et al. (1992) PNAS 89:6861-6865) or the FLP recombinase system of Saccharomyces cerevisiae (O'Gorman et al. (1991) Science 251:1351-1355; PCT publication WO 92/15694) can be used to generate in vivo site-specific genetic recombination systems. Cre recombinase catalyzes the site-specific recombination of an intervening target sequence located between loxP sequences. loxP sequences are 34 base pair nucleotide repeat sequences to which the Cre recombinase binds and are required for Cre recombinase mediated genetic recombination. The orientation of loxP sequences determines whether the intervening target sequence is excised or inverted when Cre recombinase is present (Abremski et al. (1984) J. Biol. Chem. 259:1509-1514); catalyzing the excision of the target sequence when the loxP sequences are oriented as direct repeats and catalyzes inversion of the target sequence when loxP sequences are oriented as inverted repeats.

Accordingly, genetic recombination of the target sequence is dependent on expression of the Cre recombinase. Expression of the recombinase can be regulated by promoter elements which are subject to regulatory control, e.g., tissue-specific, developmental stage-specific, inducible or repressible by externally added agents. This regulated control will result in genetic recombination of the target sequence only in cells where recombinase expression is mediated by the promoter element. Thus, the activation expression of a recombinant Delta3 protein can be regulated via control of recombinase expression.

Use of the cre/loxP recombinase system to regulate expression of a recombinant Delta3 protein requires the construction of a transgenic animal containing transgenes encoding both the Cre recombinase and the subject protein. Animals containing both the Cre recombinase and a recombinant Delta3 gene can be provided through the construction of "double" transgenic animals. A convenient method for providing such animals is to mate two transgenic animals each containing a transgene, e.g., a Delta3 gene and recombinase gene.

One advantage derived from initially constructing transgenic animals containing a Delta3 transgene in a recombinase-mediated expressible format derives from the likelihood that the subject protein, whether agonistic or antagonistic, can be deleterious upon expression in the transgenic animal. In such an instance, a founder population, in which the subject transgene is silent in all tissues, can be propagated and maintained. Individuals of this founder population can be crossed with animals expressing the recombinase in, for example, one or more tissues and/or a desired temporal pattern. Thus, the creation of a founder population in which, for example, an antagonistic Delta3 transgene is silent will allow the study of progeny from that founder in which disruption of Delta3 mediated induction in a particular tissue or at certain developmental stages would result in, for example, a lethal phenotype.

Similar conditional transgenes can be provided using prokaryotic promoter sequences which require prokaryotic proteins to be simultaneous expressed in order to facilitate expression of the Delta3 transgene. Exemplary promoters and the corresponding trans-activating prokaryotic proteins are given in U.S. Pat. No. 4,833,080.

Moreover, expression of the conditional transgenes can be induced by gene therapy-like methods wherein a gene encoding the trans-activating protein, e.g., a recombinase or a prokaryotic protein, is delivered to the tissue and caused to be expressed, such as in a cell-type specific manner. By this method, a Delta3 transgene could remain silent into adulthood until "turned on" by the introduction of the trans-activator.

In an exemplary embodiment, the "transgenic non-human animals" of the invention are produced by introducing transgenes into the germline of the non-human animal. Embryonal target cells at various developmental stages can be used to introduce transgenes. Different methods are used depending on the stage of development of the embryonal target cell. The specific line(s) of any animal used to practice this invention are selected for general good health, good embryo yields, good pronuclear visibility in the embryo, and good reproductive fitness. In addition, the haplotype is a significant factor. For example, when transgenic mice are to be produced, strains such as C57BL/6 or FVB lines are often used (Jackson Laboratory, Bar Harbor, Me.). Preferred strains are those with H-2b, H-2d or H-2q haplotypes such as C57BU6 or DBA/1. The line(s) used to practice this invention may themselves be transgenics, and/or may be knockouts (i.e., obtained from animals which have one or more genes partially or completely suppressed).

In one embodiment, the transgene construct is introduced into a single stage embryo. The zygote is the best target for micro-injection. In the mouse, the male pronucleus reaches the size of approximately 20 micrometers in diameter which allows reproducible injection of 1-2 µl of DNA solution. The use of zygotes as a target for gene transfer has a major advantage in that in most cases the injected DNA will be incorporated into the host gene before the first cleavage (Brinster et al. (1985) PNAS 82:4438-4442). As a consequence, all cells of the transgenic animal will carry the incorporated transgene. This will in general also be reflected in the efficient transmission of the transgene to offspring of the founder since 50% of the germ cells will harbor the transgene.

Normally, fertilized embryos are incubated in suitable media until the pronuclei appear. At about this time, the nucleotide sequence comprising the transgene is introduced into the female or male pronucleus as described below. In some species such as mice, the male pronucleus is preferred. It is most preferred that the exogenous genetic material be added to the male DNA complement of the zygote prior to its being processed by the ovum nucleus or the zygote female pronucleus. It is thought that the ovum nucleus or female pronucleus release molecules which affect the male DNA complement, perhaps by replacing the protamines of the male DNA with histones, thereby facilitating the combination of the female and male DNA complements to form the diploid zygote.

Thus, it is preferred that the exogenous genetic material be added to the male complement of DNA or any other complement of DNA prior to its being affected by the female pronucleus. For example, the exogenous genetic material is added to the early male pronucleus, as soon as possible after the formation of the male pronucleus, which is when the male and female pronuclei are well separated and both are located close to the cell membrane. Alternatively, the exogenous genetic material could be added to the nucleus of the sperm after it has been induced to undergo decondensation. Sperm containing the exogenous genetic material can then be added to the ovum or the decondensed sperm could be added to the ovum with the transgene constructs being added as soon as possible thereafter.

Introduction of the transgene nucleotide sequence into the embryo may be accomplished by any means known in the art such as, for example, microinjection, electroporation, or lipofection. Following introduction of the transgene nucleotide sequence into the embryo, the embryo may be incubated in vitro for varying amounts of time, or reimplanted into the surrogate host, or both. In vitro incubation to maturity is within the scope of this invention. One common method in to incubate the embryos in vitro for about 1-7 days, depending on the species, and then reimplant them into the surrogate host.

For the purposes of this invention a zygote is essentially the formation of a diploid cell which is capable of developing into a complete organism. Generally, the zygote will be comprised of an egg containing a nucleus formed, either naturally or artificially, by the fusion of two haploid nuclei from a gamete or gametes. Thus, the gamete nuclei must be ones which are naturally compatible, i.e., ones which result in a viable zygote capable of undergoing differentiation and developing into a functioning organism. Generally, a euploid zygote is preferred. If an aneuploid zygote is obtained, then the number of chromosomes should not vary by more than one with respect to the euploid number of the organism from which either gamete originated.

In addition to similar biological considerations, physical ones also govern the amount (e.g., volume) of exogenous genetic material which can be added to the nucleus of the zygote or to the genetic material which forms a part of the zygote nucleus. If no genetic material is removed, then the amount of exogenous genetic material which can be added is limited by the amount which will be absorbed without being physically disruptive. Generally, the volume of exogenous genetic material inserted will not exceed about 10 picoliters. The physical effects of addition must not be so great as to physically destroy the viability of the zygote. The biological limit of the number and variety of DNA sequences will vary depending upon the particular zygote and functions of the exogenous genetic material and will be readily apparent to one skilled in the art, because the genetic material, including the exogenous genetic material, of the resulting zygote must be biologically capable of initiating and maintaining the differentiation and development of the zygote into a functional organism.

The number of copies of the transgene constructs which are added to the zygote is dependent upon the total amount of exogenous genetic material added and will be the amount which enables the genetic transformation to occur. Theoretically only one copy is required; however, generally, numerous copies are utilized, for example, 1,000-20,000 copies of the transgene construct, in order to insure that one copy is functional. As regards the present invention, there will often be an advantage to having more than one functioning copy of each of the inserted exogenous DNA sequences to enhance the phenotypic expression of the exogenous DNA sequences.

Any technique which allows for the addition of the exogenous genetic material into nucleic genetic material can be utilized so long as it is not destructive to the cell, nuclear membrane or other existing cellular or genetic structures. The exogenous genetic material is preferentially inserted into the nucleic genetic material by microinjection. Microinjection of cells and cellular structures is known and is used in the art.

Reimplantation is accomplished using standard methods. Usually, the surrogate host is anesthetized, and the embryos are inserted into the oviduct. The number of embryos implanted into a particular host will vary by species, but will usually be comparable to the number of off spring the species naturally produces.

Transgenic offspring of the surrogate host may be screened for the presence and/or expression of the transgene by any suitable method. Screening is often accomplished by Southern blot or Northern blot analysis, using a probe that is complementary to at least a portion of the transgene. Western blot analysis using an antibody against the protein encoded by the transgene may be employed as an alternative or additional method for screening for the presence of the transgene product. Typically, DNA is prepared from tail tissue and analyzed by Southern analysis or PCR for the transgene. Alternatively, the tissues or cells believed to express the transgene at the highest levels are tested for the presence and expression of the transgene using Southern analysis or PCR, although any tissues or cell types may be used for this analysis.

Alternative or additional methods for evaluating the presence of the transgene include, without limitation, suitable biochemical assays such as enzyme and/or immunological assays, histological stains for particular marker or enzyme activities, flow cytometric analysis, and the like. Analysis of the blood may also be useful to detect the presence of the transgene product in the blood, as well as to evaluate the effect of the transgene on the levels of various types of blood cells and other blood constituents.

Progeny of the transgenic animals may be obtained by mating the transgenic animal with a suitable partner, or by in vitro fertilization of eggs and/or sperm obtained from the transgenic animal. Where mating with a partner is to be performed, the partner may or may not be transgenic and/or a knockout; where it is transgenic, it may contain the same or a different transgene, or both. Alternatively, the partner may be a parental line. Where in vitro fertilization is used, the fertilized embryo may be implanted into a surrogate host or incubated in vitro, or both. Using either method, the progeny may be evaluated for the presence of the transgene using methods described above, or other appropriate methods.

The transgenic animals produced in accordance with the present invention will include exogenous genetic material. As set out above, the exogenous genetic material will, in certain embodiments, be a DNA sequence which results in the production of a Delta3 protein (either agonistic or antagonistic), and antisense transcript, or a Delta3 mutant. Further, in such embodiments the sequence will be attached to a transcriptional control element, e.g., a promoter, which preferably allows the expression of the transgene product in a specific type of cell.

Retroviral infection can also be used to introduce transgene into a non-human animal. The developing non-human embryo can be cultured in vitro to the blastocyst stage. During this time, the blastomeres can be targets for retroviral infection (Jaenich, R. (1976) PNAS 73:1260-1264). Efficient infection of the blastomeres is obtained by enzymatic treatment to remove the zona pellucida (Manipulating the Mouse Embryo, Hogan eds. (Cold Spring Harbor Laboratory Press, Cold Spring Harbor, 1986). The viral vector system used to introduce the transgene is typically a replication-defective retrovirus carrying the transgene (Jahner et al. (1985) PNAS 82:6927-6931; Van der Putten et al. (1985) PNAS 82:6148-6152). Transfection is easily and efficiently obtained by culturing the blastomeres on a monolayer of virus-producing cells (Van der Putten et al. (1985) PNAS 82:6148-6152; Stewart et al. (1987) EMBO J. 6:383-388). Alternatively, infection can be performed at a later stage. Virus or virus-producing cells can be injected into the blastocoele (Jahner et al. (1982) Nature 298:623-628). Most of the founders will be mosaic for the transgene since incorporation occurs only in a subset of the cells which formed the transgenic non-human animal. Further, the founder may contain various retroviral insertions of the transgene at different positions in the genome which generally will segregate in the offspring. In addition, it is also possible to introduce transgenes into the germ line by intrauterine retroviral infection of the midgestation embryo (Jahner et al. (1982) Nature 298:623-628).

A third type of target cell for transgene introduction is the embryonal stem cell (ES). ES cells are obtained from pre-implantation embryos cultured in vitro and fused with embryos (Evans et al. (1981) Nature 292:154-156; Bradley et al. (1984) Nature 309:255-258; Gossler et al. (1986) PNAS 83: 9065-9069; and Robertson et al. (1986) Nature 322:445-448). Transgenes can be efficiently introduced into the ES cells by DNA transfection or by retrovirus-mediated transduction. Such transformed ES cells can thereafter be combined with blastocysts from a non-human animal. The ES cells thereafter colonize the embryo and contribute to the germ line of the resulting chimeric animal. For review see Jaenisch, R. (1988) Science 240:1468-1474.

In one embodiment, gene targeting, which is a method of using homologous recombination to modify an animal's genome, can be used to introduce changes into cultured embryonic stem cells. By targeting a Delta3 gene of interest in ES cells, these changes can be introduced into the germlines of animals to generate chimeras. The gene targeting procedure is accomplished by introducing into tissue culture cells a DNA targeting construct that includes a segment homologous to a target Delta3 locus, and which also includes an intended sequence modification to the Delta3 genomic sequence (e.g., insertion, deletion, point mutation). The treated cells are then screened for accurate targeting to identify and isolate those which have been properly targeted.

Gene targeting in embryonic stem cells is in fact a scheme contemplated by the present invention as a means for disrupting a Delta3 gene function through the use of a targeting transgene construct designed to undergo homologous recombination with one or more Delta3 genomic sequences. The targeting construct can be arranged so that, upon recombination with an element of a Delta3 gene, a positive selection marker is inserted into (or replaces) coding sequences of the targeted Delta3 gene. The inserted sequence functionally disrupts the Delta3 gene, while also providing a positive selection trait. Exemplary Delta3 targeting constructs are described in more detail below.

Generally, the embryonic stem cells (ES cells) used to produce the knockout animals will be of the same species as the knockout animal to be generated. Thus for example, mouse embryonic stem cells will usually be used for generation of knockout mice.

Embryonic stem cells are generated and maintained using methods well known to the skilled artisan such as those described by Doetschman et al. (1985) J. Embryol. Exp. Morphol. 87:27-45). Any line of ES cells can be used, however, the line chosen is typically selected for the ability of the cells to integrate into and become part of the germ line of a developing embryo so as to create germ line transmission of the knockout construct. Thus, any ES cell line that is believed to have this capability is suitable for use herein. One mouse strain that is typically used for production of ES cells, is the 129J strain. Another ES cell line is murine cell line D3 (American Type Culture Collection, catalog NO: CKL 1934) Still another preferred ES cell line is the WW6 cell line (Ioffe et al. (1995) PNAS 92:7357-7361). The cells are cultured and prepared for knockout construct insertion using methods well known to the skilled artisan, such as those set forth by Robertson in: Teratocarcinomas and Embryonic Stem Cells: A Practical Approach, E. J. Robertson, ed. IRL Press, Washington, D.C. [1987]); by Bradley et al. (1986) Current Topics in Devel. Biol. 20:357-371); and by Hogan et al. (Manipulating the Mouse Embryo: A Laboratory Manual, Cold Spring Harbor Laboratory Press, Cold Spring Harbor, N.Y. [1986]).

Insertion of the knockout construct into the ES cells can be accomplished using a variety of methods well known in the art including for example, electroporation, microinjection, and calcium phosphate treatment. A preferred method of insertion is electroporation.

Each knockout construct to be inserted into the cell must first be in the linear form. Therefore, if the knockout construct has been inserted into a vector (described infra), linearization is accomplished by digesting the DNA with a suitable restriction endonuclease selected to cut only within the vector sequence and not within the knockout construct sequence.

For insertion, the knockout construct is added to the ES cells under appropriate conditions for the insertion method chosen, as is known to the skilled artisan. Where more than one construct is to be introduced into the ES cell, each knockout construct can be introduced simultaneously or one at a time.

If the ES cells are to be electroporated, the ES cells and knockout construct DNA are exposed to an electric pulse using an electroporation machine and following the manufacturer's guidelines for use. After electroporation, the ES cells are typically allowed to recover under suitable incubation conditions. The cells are then screened for the presence of the knockout construct.

Screening can be accomplished using a variety of methods. Where the marker gene is an antibiotic resistance gene, for example, the ES cells may be cultured in the presence of an otherwise lethal concentration of antibiotic. Those ES cells that survive have presumably integrated the knockout construct. If the marker gene is other than an antibiotic resistance gene, a Southern blot of the ES cell genomic DNA can be probed with a sequence of DNA designed to hybridize only to the marker sequence Alternatively, PCR can be used. Finally, if the marker gene is a gene that encodes an enzyme whose activity can be detected (e.g., b-galactosidase), the enzyme substrate can be added to the cells under suitable conditions, and the enzymatic activity can be analyzed. One skilled in the art will be familiar with other useful markers and the means for detecting their presence in a given cell. All such markers are contemplated as being included within the scope of the teaching of this invention.

The knockout construct may integrate into several locations in the ES cell genome, and may integrate into a different location in each ES cell's genome due to the occurrence of random insertion events. The desired location of insertion is in a complementary position to the DNA sequence to be knocked out, e.g., the Delta3 coding sequence, transcriptional regulatory sequence, etc. Typically, less than about 1-5% of the ES cells that take up the knockout construct will actually integrate the knockout construct in the desired location. To identify those ES cells with proper integration of the knockout construct, total DNA can be extracted from the ES cells using standard methods. The DNA can then be probed on a Southern blot with a probe or probes designed to hybridize in a specific pattern to genomic DNA digested with particular restriction enzyme(s). Alternatively, or additionally, the genomic DNA can be amplified by PCR with probes specifically designed to amplify DNA fragments of a particular size and sequence (i.e., only those cells containing the knockout construct in the proper position will generate DNA fragments of the proper size).

After suitable ES cells containing the knockout construct in the proper location have been identified, the cells can be inserted into an embryo. Insertion may be accomplished in a variety of ways known to the skilled artisan, however a preferred method is by microinjection. For microinjection, about 10-30 cells are collected into a micropipet and injected into embryos that are at the proper stage of development to permit integration of the foreign ES cell containing the knockout construct into the developing embryo. For instance, as the appended Examples describe, the transformed ES cells can be microinjected into blastocytes.

The suitable stage of development for the embryo used for insertion of ES cells is very species dependent, however for mice it is about 3.5 days. The embryos are obtained by perfusing the uterus of pregnant females. Suitable methods for accomplishing this are known to the skilled artisan, and are set forth by, e.g., et al. (1986) Current Topics in Devel. Biol. 20:357-371.

While any embryo of the right stage of development is suitable for use, preferred embryos are male. In mice, the preferred embryos also have genes coding for a coat color that is different from the coat color encoded by the ES cell genes. In this way, the offspring can be screened easily for the presence of the knockout construct by looking for mosaic coat color (indicating that the ES cell was incorporated into the developing embryo). Thus, for example, if the ES cell line carries the genes for white fur, the embryo selected will carry genes for black or brown fur.

After the ES cell has been introduced into the embryo, the embryo may be implanted into the uterus of a pseudopregnant foster mother for gestation. While any foster mother may be used, the foster mother is typically selected for her ability to breed and reproduce well, and for her ability to care for the young. Such foster mothers are typically prepared by mating with vasectomized males of the same species. The stage of the pseudopregnant foster mother is important for successful implantation, and it is species dependent. For mice, this stage is about 2-3 days pseudopregnant.

Offspring that are born to the foster mother may be screened initially for mosaic coat color where the coat color selection strategy (as described above, and in the appended examples) has been employed. In addition, or as an alternative, DNA from tail tissue of the offspring may be screened for the presence of the knockout construct using Southern blots and/or PCR as described above. Offspring that appear to be mosaics may then be crossed to each other, if they are believed to carry the knockout construct in their germ line, in order to generate homozygous knockout animals. Homozygotes may be identified by Southern blotting of equivalent amounts of genomic DNA from mice that are the product of this cross, as well as mice that are known heterozygotes and wild type mice.

Other means of identifying and characterizing the knockout offspring are available. For example, Northern blots can be used to probe the mRNA for the presence or absence of transcripts encoding either the gene knocked out, the marker gene, or both. In addition, Western blots can be used to assess the level of expression of the Delta3 gene knocked out in various tissues of the offspring by probing the Western blot with an antibody against the particular Delta3 protein, or an antibody against the marker gene product, where this gene is expressed. Finally, in situ analysis (such as fixing the cells and labeling with antibody) and/or FACS (fluorescence activated cell sorting) analysis of various cells from the offspring can be conducted using suitable antibodies to look for the presence or absence of the knockout construct gene product.

Yet other methods of making knock-out or disruption transgenic animals are also generally known. See, for example, Manipulating the Mouse Embryo, (Cold Spring Harbor Laboratory Press, Cold Spring Harbor, N.Y., 1986). Recombinase dependent knockouts can also be generated, e.g., by homologous recombination to insert target sequences, such that tissue specific and/or temporal control of inactivation of a Delta-gene can be controlled by recombinase sequences (described infra).

Animals containing more than one knockout construct and/or more than one transgene expression construct are prepared in any of several ways. The preferred manner of preparation is to generate a series of mammals, each containing one of the desired transgenic phenotypes. Such animals are bred together through a series of crosses, backcrosses and selections, to ultimately generate a single animal containing all desired knockout constructs and/or expression constructs, where the animal is otherwise congenic (genetically identical) to the wild type except for the presence of the knockout construct(s) and/or transgene(s).

The present invention is further illustrated by the following examples which should not be construed as limiting in any way. The contents of all cited references (including literature references, issued patents, published patent applications as cited throughout this application are hereby expressly incorporated by reference. The practice of the present invention will employ, unless otherwise indicated, conventional techniques of cell biology, cell culture, molecular biology, transgenic biology, microbiology, recombinant DNA, and immunology, which are within the skill of the art. Such techniques are explained fully in the literature. See, for example, Molecular Cloning A Laboratory Manual, 2nd Ed., ed. by Sambrook, Fritsch and Maniatis (Cold Spring Harbor Laboratory Press: 1989); DNA Cloning, Volumes I and II (D. N. Glover ed., 1985); Oligonucleotide Synthesis (M. J. Gait ed., 1984); Mullis et al. U.S. Pat. No. 4,683,195; Nucleic Acid Hybridization (B. D. Hames & S. J. Higgins eds. 1984); Transcription And Translation (B. D. Hames & S. J. Higgins eds. 1984); Culture Of Animal Cells (R. I. Freshney, Alan R. Liss, Inc., 1987); Immobilized Cells And Enzymes (IRL Press, 1986); B. Perbal, A Practical Guide To Molecular Cloning (1984); the treatise, Methods In Enzymology (Academic Press, Inc., N.Y.); Gene Transfer Vectors For Mammalian Cells (J. H. Miller and M. P. Calos eds., 1987, Cold Spring Harbor Laboratory); Methods In Enzymology, Vols. 154 and 155 (Wu et al. eds.), Immunochemical Methods In Cell And Molecular Biology (Mayer and Walker, eds., Academic Press, London, 1987); Handbook Of Experimental Immunology, Volumes I-IV (D. M. Weir and C. C. Blackwell, eds., 1986); Manipulating the Mouse Embryo, (Cold Spring Harbor Laboratory Press, Cold Spring Harbor, N.Y., 1986).

Electronic Apparatus Readable Media and Arrays

Electronic apparatus readable media comprising the SPOIL molecules of the present invention is also provided. As used herein, "electronic apparatus readable media" refers to any suitable medium for storing, holding or containing data or information that can be read and accessed directly by an electronic apparatus. Such media can include, but are not limited to: magnetic storage media, such as floppy discs, hard disc storage medium, and magnetic tape; optical storage media such as compact disc; electronic storage media such as RAM, ROM, EPROM, EEPROM and the like; general hard disks and hybrids of these categories such as magnetic/optical storage media. The medium is adapted or configured for having recorded thereon a marker of the present invention.

As used herein, the term "electronic apparatus" is intended to include any suitable computing or processing apparatus or other device configured or adapted for storing data or information. Examples of electronic apparatus suitable for use with the present invention include stand-alone computing apparatus; networks, including a local area network (LAN), a wide area network (WAN) Internet, Intranet, and Extranet; electronic appliances such as a personal digital assistants (PDAs), cellular phone, pager and the like; and local and distributed processing systems.

As used herein, "recorded" refers to a process for storing or encoding information on the electronic apparatus readable medium. Those skilled in the art can readily adopt any of the presently known methods for recording information on known media to generate manufactures comprising the SPOIL molecules of the present invention.

A variety of software programs and formats can be used to store the marker information of the present invention on the electronic apparatus readable medium. For example, the nucleic acid sequence corresponding to the SPOIL molecules can be represented in a word processing text file, formatted in commercially-available software such as WordPerfect and MicroSoft Word, or represented in the form of an ASCII file, stored in a database application, such as DB2, Sybase, Oracle, or the like, as well as in other forms. Any number of dataprocessor structuring formats (e.g., text file or database) may be employed in order to obtain or create a medium having recorded thereon the SPOIL molecules of the present invention.

By providing the SPOIL molecules of the invention in readable form, one can routinely access the marker sequence information for a variety of purposes. For example, one skilled in the art can use the nucleotide or amino acid sequences of the present invention in readable form to compare a target sequence or target structural motif with the sequence information stored within the data storage means. Search means are used to identify fragments or regions of the sequences of the invention which match a particular target sequence or target motif.

The present invention therefore provides a medium for holding instructions for performing a method for determining whether a subject has a bone metabolism disorder, an inflammatory disorder, or an immune disorder or a pre-disposition to a bone metabolism disorder, an inflammatory disorder, or an immune disorder, wherein the method comprises the steps of determining the presence, absence, or aberrant production of a SPOIL molecule or a SPOIL variant and based on the presence, absence or aberrant production of a SPOIL molecule or a SPOIL variant, determining whether the subject has a bone metabolism disorder, an inflammatory disorder, or an immune disorder or a pre-disposition to a bone metabolism disorder, an inflammatory disorder, or an immune disorder and/or recommending a particular treatment for the bone metabolism disorder, an inflammatory disorder, or an immune disorder.

The present invention therefore provides a medium for holding instructions for performing a method for determining whether a subject has a bone metabolism disorder, an inflammatory disorder, or an immune disorder or a pre-disposition to a bone metabolism disorder, an inflammatory disorder, or an immune disorder, wherein the method comprises the steps of determining the presence, absence, or aberrant production of a SPOIL molecule or a SPOIL variant and based on the presence, absence or aberrant production of a SPOIL molecule or a SPOIL variant, determining whether the subject has a bone metabolism disorder, an inflammatory disorder, or an immune disorder or a pre-disposition to a bone metabolism disorder, an inflammatory disorder, or an immune disorder and/or recommending a particular treatment for the bone metabolism disorder, an inflammatory disorder, or an immune disorder. The method may further comprise the step of receiving phenotypic information associated with the subject and/or acquiring from a network phenotypic information associated with the subject.

The present invention also provides in a network, a method for determining whether a subject has a hematological disorder or a pre-disposition to a bone metabolism disorder, an inflammatory disorder, or an immune disorder or a pre-disposition to a bone metabolism disorder, an inflammatory disorder, or an immune disorder associated with the SPOIL molecules, said method comprising the steps of receiving information associated with the SPOIL molecule, receiving phenotypic information associated with the subject, acquiring information from the network corresponding to the SPOIL molecule and its associated disorders, and based on one or more of the phenotypic information, the SPOIL molecule, and the acquired information, determining whether the subject has a bone metabolism disorder, an inflammatory disorder, or an immune disorder or a pre-disposition to a bone metabolism disorder, an inflammatory disorder, or an immune disorder. The method may further comprise the step of recommending a particular treatment for the bone metabolism disorder, the inflammatory disorder, or the immune disorder or a pre-disposition to the bone metabolism disorder, the inflammatory disorder, or the immune disorder.

The present invention also provides a business method for determining whether a subject has a bone metabolism disorder, an inflammatory disorder, or an immune disorder or a pre-disposition to a bone metabolism disorder, an inflammatory disorder, or an immune disorder, said method comprising the steps of receiving information associated with the SPOIL molecules, receiving phenotypic information associated with the subject, acquiring information from the network corresponding to the SPOIL molecules and its associated disorders, and based on one or more of the phenotypic information, the SPOIL molecule, and the acquired information, determining whether the subject has a bone metabolism disorder, an inflammatory disorder, or an immune disorder or a pre-disposition to a bone metabolism disorder, an inflammatory disorder, or an immune disorder. The method may further comprise the step of recommending a particular treatment for the bone metabolism disorder, the inflammatory disorder, or the immune disorder or a pre-disposition to the bone metabolism disorder, the inflammatory disorder, or the immune disorder.

The invention also includes an array comprising a SPOIL molecule of the present invention. The array can be used to assay expression of one or more genes in the array. In one embodiment, the array can be used to assay gene expression in a tissue to ascertain tissue specificity of genes in the array. In this manner, up to about 7600 genes can be simultaneously assayed for expression. This allows a profile to be developed showing a battery of genes specifically expressed in one or more tissues.

In addition to such qualitative determination, the invention allows the quantitation of gene expression. Thus, not only tissue specificity, but also the level of expression of a battery of genes in the tissue is ascertainable. Thus, genes can be grouped on the basis of their tissue expression per se and level of expression in that tissue. This is useful, for example, in ascertaining the relationship of gene expression between or among tissues. Thus, one tissue can be perturbed and the effect on gene expression in a second tissue can be determined. In this context, the effect of one cell type on another cell type in response to a biological stimulus can be determined. Such a determination is useful, for example, to know the effect of cell-cell interaction at the level of gene expression. If an agent is administered therapeutically to treat one cell type but has an undesirable effect on another cell type, the invention provides an assay to determine the molecular basis of the undesirable effect and thus provides the opportunity to co-administer a counteracting agent or otherwise treat the undesired effect. Similarly, even within a single cell type, undesirable biological effects can be determined at the molecular level. Thus, the effects of an agent on expression of other than the target gene can be ascertained and counteracted.

In another embodiment, the array can be used to monitor the time course of expression of one or more genes in the array. This can occur in various biological contexts, as disclosed herein, for example development of hematological disorder, progression of hematological disorder, and processes, such a cellular transformation associated with hematological disorder.

The array is also useful for ascertaining the effect of the expression of a gene on the expression of other genes in the same cell or in different cells. This provides, for example, for a selection of alternate molecular targets for therapeutic intervention if the ultimate or downstream target cannot be regulated.

The array is also useful for ascertaining differential expression patterns of one or more genes in normal and abnormal cells. This provides a battery of genes that could serve as a molecular target for diagnosis or therapeutic intervention.

This invention is further illustrated by the following examples which should not be construed as limiting. The contents of all references, patents and published patent applications cited throughout this application, as well as the Figures and the Sequence Listing are incorporated herein by reference.

EXAMPLES

Example 1

Isolation of a Full-Length cDNA Encoding Human Delta3

Human microvascular endothelial cells (HMVEC catalog #CC2543; Clonetics, San Diego, Calif.) were separated into four samples of cells which were treated as follows. The first sample was untreated. The second sample was treated with human TGF-β1 (hTGF-β1) (10 ng/ml) (Upstate Biotechnology, Lake Placid, N.Y., Catalog NO: 01-134). The third sample was treated with bFGF (10 ng/ml)/VEGF (25 ng/ml) (Upstate Biotechnology, Lake Placid, N.Y., Catalog NO: 01-134, Catalog Nos. 01-106 and 01-185, respectively). The fourth sample was differentiated on Matrigel (Collaborative Biomedical Products, Becton Dickinson Labware, Bedford, Mass.). Cells were treated as indicated for 24 hours, the 4 samples were pooled, and RNA was extracted from the pooled cells using a QIAGEN RNeasy kit. The resulting cDNA library was subjected to high throughput random sequencing. This allowed identification of a cDNA fragment comprising the following 171 nucleotide long sequence:

(SEQ ID NO: 21)
GCCCAGGCNGACCCTGGTGTGGACTGTGAGCTGGAGCTCAGCGAGTGTGA

CAGCAACCCCTGTCGCANTGGAGGCAGCTGTAAGGACCANGAGGATGGCT

ACCACTGCCTGTGTCCTCCGGGCTACTACGGCNTGCATCGTGAACACNGC

ACCTCTTAGCTGNGCCGACTC.

Comparison of the nucleotide sequence of this partial cDNA with the sequences in GenBank using the BLAST program (Altschul et al. (1990) *J. Mol. Biol.* 215:403) revealed that the nucleotide sequence encoded a protein fragment having a significant homology to Delta proteins. In fact, the amino acid sequence had significant homology with a chicken Delta1 protein (GenBank Accession NO: U26590), a *Xenopus* Delta1 protein (GenBank Accession NO: L42229), a rat Delta1 protein (GenBank Accession NO: U78889), a *Xenopus* Delta2 protein (GenBank Accession NO: U70843) as well as Notch proteins.

A full-length cDNA of about 3.2 kb was then isolated by screening a human microvascular endothelial cell (HMVEC) cDNA library using the partial cDNA (SEQ ID NO:21). This nucleic acid was deposited at the American Type Culture Collection (ATCC®) on Mar. 5, 1997, and has been assigned ATCC® Accession NO: 98348. The nucleotide sequence of the cDNA isolated is shown in SEQ ID NO:1.

A nucleic acid sequence comparison of SEQ ID NO:1 against EST sequence databases using the BLAST program (Altschul et al. (1990) *J. Mol. Biol.* 215:403) indicated that 5 ESTs have a homology to portions of SEQ ID NO: 1. These are all located 3' of the nucleotide sequence encoding the transmembrane domain, i.e., downstream of nucleotide 1996 of SEQ ID NO:1. Three of these ESTs (having accession Nos. T33770, T33811, and T07963) have a nucleotide sequence starting at about nucleotide 2044 of SEQ ID NO: 1. However, the nucleotide sequence of the three EST is significantly different from the nucleotide sequence of hDelta3 in about the first 50 nucleotides 3' of nucleotide 2044 of SEQ ID NO:1. Two ESTs (having Accession Nos. R32717 and T07962) are located further downstream of the three ESTs.

The nucleic acid having SEQ ID NO:1 encodes a protein of 685 amino acids having SEQ ID NO:2. A comparison of the amino acid sequence of SEQ ID NO:2 with sequences in GenBank using BLASTP (Altschul et al. (1990) J. Mol. Biol. 215:403) reveals that this protein has a certain homology to previously described Delta proteins. An alignment of the human Delta3 protein having SEQ ID NO:2 with the amino acid sequence of mouse Delta1 protein (Accession NO: X80903), rat Delta1 protein (Accession NO: U78889), chicken Delta1 protein (Accession NO: U26590), two *Xenopus* Delta1 proteins (Accession Nos. L42229 and U70843)

and *Drosophila* Delta1 protein (Accession NO: AA142228) indicates that human Delta3 protein has the general structure of a Delta3 protein. In particular, human Delta3 protein has a signal peptide corresponding to about amino acid 1 to about amino acid 17 of SEQ ID NO:2, a DSL motif corresponding to the sequence from about amino acid 173 to about amino acid 217, a first E5F-like domain corresponding to the sequence from about amino acid 222 to about amino acid 250, a second EGF-like domain corresponding to the sequence from about amino acid 253 to about amino acid 281, a third EGF-like domain corresponding to the sequence from about amino acid 288 to about amino acid 321, a fourth EGF-like domain corresponding to the sequence from about amino acid 328 to about amino acid 359, a fifth EGF-like domain corresponding to the sequence from about amino acid 366 to about amino acid 399, a sixth EGF-like domain corresponding to the sequence from about amino acid 411 to about amino acid 437, a seventh EGF-like domain corresponding to the sequence from about amino acid 444 to about amino acid 475, an eight EGF-like domain corresponding to the sequence from about amino acid 484 to about amino acid 517, a transmembrane domain corresponding to the sequence from about amino acid 530 to about amino acid 553, and a cytoplasmic domain corresponding to the sequence from about amino acid 554 to about amino acid 685 of SEQ ID NO:2.

An amino acid and nucleotide sequence comparison between the members of the Delta1 and Delta3 protein family and human Delta3 on one hand and between the members of the Delta1 family reveals that the homology between the Delta3 family members is stronger than the homology between human Delta3 and any of the Delta1 family members. For example, although hDelta3 is only approximately 58% similar to the *Drosophila* Delta1 protein; approximately 70% similar to the mouse Delta1 protein; approximately 70% similar to the rat Delta1 protein; approximately 68% similar to the chick Delta1 protein; and approximately 68% similar to the *Xenopus* Delta1 proteins; the *drosophila*, mouse, rat, chick and *Xenopus* Delta1 proteins are very similar to each other (e.g., the mouse and rat Delta1 are about 96% similar to each other). Published PCT application WO97/01571 discloses a partial nucleotide and amino acid sequence of a protein having significant homology to Delta1 family members, indicating that it is likely to be a human Delta1 protein. The homology between the partial amino acid sequence of human Delta1 and the amino acid sequence of human Delta3 is indicated in Table I and shows that the proteins are encoded by different genes. All these amino acid and nucleotide sequence comparisons indicate that human Delta3 is an additional species of Delta proteins, sharing some sequence and structure homology with the Delta1 proteins.

In one embodiment of a nucleotide sequence of human Delta3, the nucleotide at position 455 is a guanine (G) (SEQ ID NO:1). In this embodiment, the amino acid at position 40 is glutamate (E) (SEQ ID NO:2). In another embodiment of a nucleotide sequence of human Delta3, the nucleotide at position 455 is a cytosine (C) (SEQ ID NO:27). In this embodiment, the amino acid at position 40 is glutamine (Q) (SEQ ID NO:28). In another embodiment of a nucleotide sequence of human Delta3, the nucleotide at position 455 is a thymidine (T) (SEQ ID NO:29). In this embodiment, the amino acid at position 40 is a stop codon (SEQ ID NO:30). In another embodiment of a nucleotide sequence of human Delta3, the nucleotide at position 455 is a adenine (A) (SEQ ID NO:31). In this embodiment, the amino acid at position 40 is lysine (K) (SEQ ID NO:32).

In one embodiment of a nucleotide sequence of human Delta3, the nucleotide at position 786 is an cytosine (C) (SEQ ID NO:1). In this embodiment, the amino acid at position 150 is a alanine (A) (SEQ ID NO:2). In an alternative embodiment, a species variant of human Delta3 has a nucleotide at position 786 which is a thymidine (T) (SEQ ID NO:33). In this embodiment, the amino acid at position 150 is valine (V) (SEQ ID NO:34), i.e., a conservative substitution.

In one embodiment of a nucleotide sequence of human Delta3, the nucleotide at position 594 is a cytosine (C) (SEQ ID NO:1). In this embodiment, the amino acid at position 86 is threonine (T) (SEQ ID NO:2). In an alternative embodiment, a species variant of human Delta3 has a nucleotide at position 594 which is a guanine (G) (SEQ ID NO:35). In this embodiment, the amino acid at position 86 is serine (S) (SEQ ID NO:36), i.e., a conservative substitution.

In one embodiment of a nucleotide sequence of human Delta3, wherein the nucleotide at position 883 is a thymidine (T) (SEQ ID NO:1). In this embodiment, the amino acid at position 182 is aspartate (D) (SEQ ID NO:2). In an alternative embodiment, a species variant of human Delta3 has a nucleotide at position 883 which is an adenine (A) (SEQ ID NO:37). In this embodiment, the amino acid at position 182 is glutamate (E) (SEQ ID NO:38), i.e., a conservative substitution.

Example 2

Isolation of a Full-Length cDNA Encoding Mouse Delta3

A mouse Delta3 cDNA was identified from mouse lung database library of expressed sequences using the human Delta3 cDNA (SEQ ID NO:1) as a query sequence. The most homologous sequence, SEQ ID NO:24 was identified as a 3.2 kb cDNA.

The nucleic acid having SEQ ID NO:24 encodes a protein of 686 amino acids having the amino acid sequence shown in SEQ ID NO:25. An alignment of the human and mouse Delta3 proteins having SEQ ID NO:2 and 25, respectively, indicates that human and mouse Delta3 proteins have significant similarity and identity (i.e., 88.2% similar and 86.6% identical) suggesting evolutionary conservation due to an essential biological function.

Mouse Delta3 protein has a signal peptide corresponding to about amino acid 1 to about amino acid 17 of SEQ ID NO:25, a DSL motif corresponding to the sequence from about amino acid 174 to about amino acid 218, a first EGF-like domain corresponding to the sequence from about amino acid 223 to about amino acid 251, a second EGF-like domain corresponding to the sequence from about amino acid 254 to about amino acid 282, a third EGF-like domain corresponding to the sequence from about amino acid 289 to about amino acid 322, a fourth EGF-like domain corresponding to the sequence from about amino acid 329 to about amino acid 360, a fifth EGF-like domain corresponding to the sequence from about amino acid 367 to about amino acid 400, a sixth EGF-like domain corresponding to the sequence from about amino acid 412 to about amino acid 438, a seventh EGF-like domain corresponding to the sequence from about amino acid 445 to about amino acid 476, an eight EGF-like domain corresponding to the sequence from about amino acid 485 to about amino acid 518, a transmembrane domain corresponding to the sequence from about amino acid 531 to about amino acid 554, and a cytoplasmic domain corresponding to the sequence from about amino acid 555 to about amino acid 686 of SEQ ID NO:25.

In one embodiment of a nucleotide sequence of mouse Delta3, the nucleotide at position 49 is cytosine (C) (SEQ ID NO:24). In this embodiment, the amino acid at position 4 is alanine (A) (SEQ ID NO:25). In an alternative embodiment, a species variant of mouse Delta3 has a nucleotide at position 49 which is thymidine (T) (SEQ ID NO:39). In this embodiment, the amino acid at position 4 is valine (V) (SEQ ID NO:40), i.e., a conservative substitution.

In one embodiment of a nucleotide sequence of mouse Delta3, the nucleotide at position 51 is thymidine (T) (SEQ ID NO:24). In this embodiment, the amino acid at position 5 is serine (S) (SEQ ID NO:25). In an alternative embodiment, a species variant of mouse Delta3 has a nucleotide at position 51 which is a adenine (A) (SEQ ID NO:41). In this embodiment, the amino acid at position 5 is threonine (T) (SEQ ID NO:42), i.e., a conservative substitution.

In one embodiment of a nucleotide sequence of mouse Delta3, the nucleotide at position 109 is guanine (G) (SEQ ID NO:24). In this embodiment, the amino acid at position 24 is arginine (R) (SEQ ID NO:25). In an alternative embodiment, a species variant of mouse Delta3 has a nucleotide at position 109 which is adenine (A) (SEQ ID NO:43). In this embodiment, the amino acid at position 24 is histidine (H) (SEQ ID NO:44), i.e., a conservative substitution.

In one embodiment of a nucleotide sequence of mouse Delta3, wherein the nucleotide at position 130 is a thymidine (T) (SEQ ID NO:24). In this embodiment, the amino acid at position 31 is phenylalanine (F) (SEQ ID NO:25). In an alternative embodiment, a species variant of mouse Delta3 has a nucleotide at position 130 which is adenine (A) (SEQ ID NO:45). In this embodiment, the amino acid at position 31 is tyrosine (Y) (SEQ ID NO:46), i.e., a conservative substitution.

Example 3

Tissue Expression of the hDelta3 Gene

This Example describes the tissue distribution of Delta3 protein, as determined by Northern blot hybridization with a 1.6 kb fragment of human Delta3 cDNA corresponding to the extreme 3' end of SEQ ID NO: 1 and by in situ hybridization using a probe complementary to nucleotides 1290-1998 of SEQ ID NO:1.

Northern blot hybridizations with the various RNA samples were performed under standard conditions and washed under stringent conditions, i.e., in 0.2×SSC at 65° C. In each sample, the probe hybridized to a single RNA of about 3.5 kb. The results of hybridization of the probe to various mRNA samples are described below.

Hybridization of a Clontech Fetal Multiple Tissue Northern (MTN) blot (Clontech, LaJolla, Calif.) containing RNA from fetal brain, lung, liver, and kidney indicated the presence of Delta3 RNA in each of these fetal tissues. Expression was significantly higher in fetal lung and kidney than in fetal brain and liver. Hybridization of a Clontech human Multiple Tissue Northern I (MTNI) and Multiple Tissue Northern II (MTNII) blots (Clontech, LaJolla, Calif.) containing RNA from adult heart, brain, placenta, lung, liver, skeletal muscle, kidney, pancreas, spleen, thymus, prostate, testis, ovary, small intestine, mucosal lining of the colon, and peripheral blood leukocytes with the human 1.6 kb Delta3 probe indicated expression in heart, placenta, lung, skeletal muscle, kidney, pancreas, spleen, thymus, prostate, testis, ovary, small intestine and colon. Expression was particularly strong in adult heart, placenta, lung, and skeletal muscle. Expression was also found in adult brain, liver and testis. However, no significant amount of hDelta3 mRNA was detected in adult peripheral blood leukocytes.

Further, Northern blot hybridization of total mRNA from HMVEC cells treated with TGF-β1 at 10 ng/ml for 24 hours, bFGF at 10 ng/ml/VEGF at 25 ng/ml for 24 hours, or untreated for 24 hours indicated that Delta3 expression was induced upon induction with bFGF/VEGF. Accordingly, expression of Delta3 is up-regulated in HMV endothelial cells in response to certain growth factors.

Hybridization of a "cancer" Northern blot containing RNA from HL-60, HeLa, K562, MoLT4, Raji, SW480, A549, and G361 cells, revealed that Delta3 is expressed at high levels in the colorectal carcinoma cell line SW480. Thus, Delta3 expression is high in at least certain tumor cells.

Delta-3 in situs on paraffin embedded mouse embryos were performed. Expression was seen in endothelial cells of the secondary vasculature and in preendothelial cells in the bone marrow. There is no expression in endothelial cells after day P 1.5.

For in situ hybridization analysis of mDelta3, 10 m sagittal sections of fresh frozen day E13.5, E14.5, E15.5, E16.5, E18.5 and P1.5 embryos of B6 mice, as well as 8 m cross sections of brain, spinal cord, eye and harderian gland, submandibular gland, white fat, stomach, heart, lung, liver, spleen, thymus, small intestine, lymph node, pancreas, skeletal muscle, testes, ovary, placenta, kidney and adrenal gland from adult B6 mice were used for hybridization. Sections were postfixed with 4% formaldehyde in DEPC-treated 1× phosphate-buffered saline at room temperature for 10 minutes before being rinsed twice in DEPC-treated 1× phosphate-buffered saline and once in 0.1 M triethanolamine-HCl (pH8.0). Following incubation in 0.25% acetic anhydride-0.1 M triethanolamine-HCl for 10 minutes, sections were rinsed in DEPC-treated 2×SSC (1×SSC is 0.15M NaCl plus 0.015M sodium citrate). Tissue was dehydrated through a series of ethanol washes, incubated in 100% chloroform for 5 minutes, and then rinsed in 100% ethanol for 1 minute and 95% ethanol for 1 minute and allowed to air dry.

The hybridization was performed using a $^{35}$S-radiolabeled cRNA probe from the DNA sequence of nucleotides 1290-1998 of SEQ ID NO:1.

Tissues were incubated with probe (approximately $5×10^7$ cpm/ml) in the presence of a solution containing 600 mM NaCl, 10 mM Tris (pH 7.5), 1 mM EDTA, 0.01% sheared salmon sperm DNA, 0.01% yeast tRNA, 0.05% yeast total RNA type X1, 1×Denhardt's solution, 50% formamide, 10% dextran sulfate, 100 mM dithiothreitol, 0.1% sodium dodecylsulfate (SDS), and 0.1% sodium thiosulfate for 18 h at 55C.

After hybridization, slides were washed with 2×SSC. Sections were then sequentially incubated at 37C in TNE (a solution containing 10 mM Tris-HCl (pH 7.6), 500 mM NaCl, and 1 mM EDTA), for 10 minutes, in TNE with 10 ug of RNase A per ml for 30 minutes, and finally in TNE for 10 minutes. Slides were then rinsed with 2×SSC at room temp, washed with 2×SSC at 50° C. for 1 hour, washed with 0.2× SSC at 55° C. for 1 hour, and 0.2×SSC at 60° C. for 1 hour. Sections were then dehydrated rapidly through serial ethanol-0.3 M sodium acetate concentrations before being air dried and exposed to Kodak Biomax MR scientific imaging film for 6 days at room temperature. Expression was most abundant and wide spread during embryogenesis. Strongest expression was observed in the eye in all of the embryonic ages tested. Signal in a pattern suggestive of neuronal expression was not observed in any other tissues making the expression in the eye unique. Moderate ubiquitous expression was also detected in lung, thymus and brown fat during embryogenesis. A multifocal, scattered signal was also observed throughout the embryo. This signal pattern was more focused in the cortical region of the kidney and outlining the intestinal tract. Adult expression was highest in the ovary and the cortical regions of the kidney and adrenal gland.

Thus, Delta3 is expressed in numerous tissues, but is not detected in certain tissues, e.g., peripheral blood leukocytes and adult heart tissue (at least when using Northern blot hybridization), is expressed at relatively high levels in at least some tumor cells, e.g., colon carcinoma cells, and its expression can be up-regulated in response to some growth factors, e.g., bFGF and VEGF. Furthermore, in situ hybridization shows that mDelta3 is expressed most strongly in developing tissues of eye, thymus, lung and brown fat.

A Southern blot containing DNA from a panel of a human/hamster mono-chromosomal somatic cell hybrids was probed with an hDelta1cDNA probe. The results obtained clearly indicates that the human Delta3 gene resides on chromosome 15.

Example 4

Increased Expression of hDelta3 in Differentiating Endothelial Cells

This Example shows that the expression of the hDelta3 gene increases in differentiating endothelial cells relative to non-differentiating endothelial cells.

HMVEC cells were separated into 5 cultures and treated as follows: (1) cells were induced to quiescence by growth in basal endothelial growth medium (EGM) (Clontech) which contains 10% fetal calf serum (FCS); (2) cells were grown in complete endothelial growth medium (EGM-MV) (Clontech, Catalog NO: CC-3125) which contains 10% FCS and growth factors; (3) cells were stimulated to proliferate by culture in EGM-MV in the presence of bFGF at 10 ng/ml and VEGF at 25 ng/ml; (4) cells were stimulated to proliferate by culture in EGM-MV in the presence of TGF-β1 at 10 ng/ml; and (5) cells were stimulated to differentiate by culture in EGM-MV on Matrigel. After 24 hours of culture, the cells were harvested, the RNA was extracted and submitted to Northern blot analysis. Hybridization was performed with the 1.6 kb hDelta3 probe described above. The results indicate that among the culture conditions tested, quiescent cells express the lowest amount of hDelta3 (at a barely detectable level). Cells which are proliferating express a higher level of hDelta3. Interestingly, the mRNA level of hDelta3 was strongly increased in cells induced to differentiate by plating on Matrigel.

Thus, this Example clearly demonstrates that hDelta3 expression is strongly increased in cells induced to differentiate and also in cells induced to proliferate.

Example 5 hDelta3 is Located in a Chromosomal Region Associated with ACCPN

The location of hDelta3 on human chromosome 15 was determined using radiation hybrid (RH) mapping.

A sequence tagged site (STS) was generated from the 3' untranslated region of the gene using a forward primer having the nucleotide sequence GTTTACATTGCATCCTGGAT (SEQ ID NO:51) and a reverse primer having the nucleotide sequence CTCTTCTGTTCCTCTGGTTG (SEQ ID NO:22). The STS was used to screen the Genebridge 4 (Gyapay et al. (1996) Human Molecular Genetics 5:339) and the Standford G3 (Stewart et al. (1997) Genome Res. 7:422) radiation hybrid panels. These panels were derived by fusion of irradiated human donor cells with rodent recipient cells and can be used for positioning STS markers within existing framework maps, ordering markers in the region of interest as well as establishing the distance between markers.

RH mapping was performed by PCR under the following conditions: 25 ng DNA/20 µl reaction, 0.5 µM of each primer, 0.2 mM of each nucleotide, 1.5 mM $MgCl_2$, 1× buffer as provided by the manufacturer of the enzyme, 35 cycles at 94° C., 55° C., 72° C. for 30 seconds each.

The results of the RH mapping indicated that hDelta3 maps to 15q12-15 close to framework marker D15S1244 on the Stanford G3 panel and close to framework marker D15S144 on the Genebridge 4 panel with a LOD score >3. Searching of the OMIM database (Online Mendelian Inheritance in Man) indicated that this region has previously been genetically linked to a neurological disorder called Agenesis of the Corpus Callosum with Peripheral Neuropathy (ACCPN) (Casaubon et al. (1996) *Am. J. Hum. Genet.* 58:28).

Example 6

Delta3 Encodes A Notch Ligand

The example presented herein demonstrates that Delta3 encodes a Notch Ligand. In particular, the data presented herein shows, first, that hDelta3 encodes a functional Notch ligand as determined by its ability to block differentiation of C2C12 cells. When C2C12 cells are co-cultured, under low mitogenic conditions, with NIH3T3 cells expressing a Notch ligand, the differentiation to myotubes by the C2C12 cells is blocked. (Lindsell et al. (1995) *Cell* 80:909). If the cells differentiate troponin T is expressed, if differentiation is blocked no troponin T expression is seen. In addition, the data presented herein directly demonstrates that Delta3 binds Notch one and Notch 2. Third, the data presented in this section identifies several cell types that endogenously exhibit Delta3 receptors.

To determine whether hDelta3 in fact encodes a functional Notch ligand, NIH3T3 cells were engineered to express hDelta3, co-cultured with C2C12 cells and analyzed for troponin T expression. Briefly, NIH3T3 cells were infected with a retrovirus containing the hDelta3 coding region cloned into the MIGR retroviral vector (Pear et al. (1998) *Blood* 92:3780). This vector contains an Internal Ribosome Entry Site (IRES) downstream of the cloning site, followed by the cDNA for the green fluorescent protein (GFP). GFP expression from the vector is monitored to assess the efficiency of transduction of the vector into the target cells. C2C12 cells were plated in 10 cm dishes and cultured in DMEM media with 10%

Inactivated Fetal Calf Serum (10% IFS) until 70% confluent. C2C12 cells were then washed 1× with PBS. $5 \times 10^6$ NIH3T3 cells harboring either an empty vector, a vector expressing hDelta3 or a vector expressing Jagged-I were resuspended in 10 mls DMEM media containing 10% Horse serum (10% HS), and laid on top of the C2C12 cells.

Control experiments involved the solitary culture of C2C12 cells in differentiation media (10% HS) as well as in growth media (10% IFS). The whole population of cells was lysed three to four days later and equal amounts of protein was resolved on an SDS-polyacrylamide gel. The proteins were then transferred onto a nitrocellulose membrane and probed with an anti-Troponin T antibody (Sigma, 1:200). A secondary incubation with an anti-mouse antibody conjugated to horseradish peroxidase allowed for detection using chemiluminescence reagents (Amersham). When cells NIH3T3 cells containing the empty vector were co-cultured with C2C12 cells, troponin T was expressed, indicating that the C2C12 cells had indeed differentiated into myotubes. When NIH3T3 cells expressing hDelta3 were co-cultured with C2C12 cells, no expression of troponin T was seen, indicating that C2C12 differentiation was blocked by hDelta3. This result is similar to that seen when NIH3T3 cells expressing Jagged 1 (a functional Notch ligand).

Next, Delta3 was tested for its ability to bind human notch1 and notch2. 293T cells were transiently transfected with expression plasmids (PCMV poly-neo) encoding full-length Notch1 or Notch2. Two days after transfection cells were incubated with purified protein consisting of the extracellular domain of hDelta3 fused in frame to the Fc portion of immunoglobulin G (hDelta3-Fc) at 10 µg/ml or with control protein consisting of human immunoglobulin G1 (hIgG1) at 10 ug/ml in staining buffer (PBS containing 3% fetal calf serum, 1 mM $CaCl_2$ and 0.02% sodium azide). After one hour of incubation, cells were washed three times in staining buffer and bound protein was detected by incubating the cells with FITC-conjugated anti-human IgG for 30 minutes. Cells were analyzed under fluorescence microscopy.

Binding of hDelta3-Fc fusions to cells expressing Notch1 and Notch2 but not to cells transfected with empty expression vector, was detected. Binding was calcium-dependent and was abolished in the presence of 5 mM EDTA. Control-Fc fusions and hIgG1 did not show any binding to transfected cells. These results establish hDelta3 as a ligand for Notch 1 and Notch2 and show that the extracellular domain of hDelta3 is sufficient to mediate binding to Notch.

Therefore, Delta3, including hDelta3, represents a polypeptide which can function as a bona fide Notch ligand.

Next, Cell lines were tested for the presence of an endogenous receptor for hDelta3. Briefly, cells were washed two times in staining buffer and incubated with hDelta3-Fc or hIgG1 (10 µg/ml in staining buffer) at a cell concentration of $5 \times 10^6$ per ml. After an incubation of one hour on ice, cells were washed three times in staining buffer and bound protein was detected by incubating the cells with FITC-conjugated secondary antibody (anti-human hIgG1) for 30 min on ice. Cells were analyzed by flow cytometry on a FACSCalibur. Binding of hDelta3-Fc was seen to Jurkat, 32D, C2C12 and Cos cells. A control Fc fusion protein and hIgG1 did not show binding to these cell lines. The binding of hDelta3-Fc was dependent on calcium since the binding was abolished by the addition of 5 mM EDTA to the binding buffer.

Example 7

Delta3 Affects Early Development and Muscle Cell Differentiation

The data presented herein demonstrate that among the roles of Delta3 is a function that involves early development and muscle cell differentiation.

Materials and Methods

Preparation of hDelta3 RNA: The template for the hDelta3 in vitro transcription reaction was prepared from the DNA construct containing the hDelta3 sequence inserted in a pCS2++vector, which was then linearized using AscI. Capped RNA was synthesized using SP6 RNA polymerase from the linearized plasmid using mMESSAGE mMACHINE kit (Ambion, Austin, Tex.) according to the manufacturer's instructions. In vitro transcribed capped RNA was purified using RNAesy kit (Qiagen) and analyzed by gel electrophoresis.

HDelta3 RNA injection into *Xenopus* embryos: *Xenopus* embryos were obtained by in vitro fertilization, dejellied in 2% cysteine HCl (pH 7.6), washed thoroughly in Modified Ringer's solution, and incubated at 15-25° C. Embryos were transferred to injection solution (Modified Ringer's solution containing 3% Ficoll) prior to injections. One ng and 2.5 ng of hDelta3 RNA were injected into one blastomere at the 2-cell stage. Embryos were transferred to 0.1× MMR from the injection solution after approximately 6 hours and grown until the appropriate stage.

Embryos for histological examination were fixed in 4% formaldehyde in PBS overnight, embedded in paraffin and stained with Heidenhain's Azan stain by standard procedures. Transverse sections of injected embryos show disruption of somitic organization and somite boundaries on the injected side.

*Xenopus* animal cap assay: 2 ng of hDelta3 RNA was injected into the animal pole of each of the 2 *Xenopus* blastomeres at the 2-cell stage. Animal caps from uninjected or injected embryos were explanted at stage 9 and cultured in 1XModified Ringers containing 0.01% BSA and 50 ug/ml gentamycin. Animal caps were cultured until control embryos have reached stage 23-24. Animal cap tissue was lysed and total RNA was extracted using RNeasy kit (Qiagen). RT-PCRs were performed on these samples using gene-specific primers and appropriate annealing temperatures and the products analyzed by gel electrophoresis. The primers used in this experiment were specific to genes EF1-alpha, XCG-1, NCAM, Xbra, M-actin, Sox-17 (Amaravadi et al. (1997). *Dev. Biol.* 192:392-404). RT-PCR analysis did not indicate expression of any of the specific marker genes tested.

Results:

Examination of embryos injected with hDelta3 RNA two days post-injection showed an overexpression phenotype involving axial disruption indicative of an effect on somites and anterior dorsal structures such as eyes and cement glands were not well differentiated in half of the injected embryos. These results suggest that hDelta3 has an effect on early tissue development/differentiation.

The differential stain used in this study also indicated an enlargement of somite size on the injected side demonstrating that hDelta3 has an effect on muscle cells and overexpression can lead to enlarged muscle mass. Notch/Delta signaling has been shown to play a key role in somitogenesis/myogenesis in various species (Wittenberger et al., (1999) *EMBO J.* 18:915-922); Dornseifer et al. (1997) *Mech. Dev.* 63:159-171); Kusumi et al. (1998) *Nat. Genet.* 19:274-278).

Therefore, the results presented herein indicate that Delta3 can be involved in early development (e.g., can have a role downstream of germ layer specification function), and can be involved in modulating myogenesis and muscle cell differentiation.

Example 8

Identification of Delta Therapeutics

This Example describes a simple assay for isolating Delta therapeutics, (e.g., agonist or antagonist of a Delta activity), e.g., Delta3 therapeutics. Based at least in part on the results described in the previous Examples, Delta therapeutics can be used for treating various diseases, including neurological diseases, and/or hyper- or hypoproliferative diseases, hematologic disorders, immunodeficiency states and diseases or conditions associated with defects in vasculature and/or conditions requiring neovascularization and/or conditions hallmarked by aberrant neovascularization, e.g., diabetic retinopathy. In addition, based at least in part on the similarity of amino acid sequence and structure between the various Delta proteins, Delta3 therapeutics can be used to treat diseases or conditions associated with an aberrant Delta3 activity or an aberrant Delta activity other than a Delta3 activity. Similarly, Delta3 therapeutics as well as Delta therapeutics other than Delta3 therapeutics can be used to treat diseases or conditions associated with an aberrant Delta3 activity. The assay set forth below is applicable to Delta proteins other than Delta3 proteins.

A Delta3 therapeutic can be identified by using an in vitro assay, in which the interaction between a Delta3 protein and a Delta3 binding protein, e.g., a Notch protein, is determined in the presence and in the absence of a test compound. A soluble binding fragment of a Delta3 protein can be prepared by expression of the extracellular portion of human Delta3, e.g., about amino acids 1-529 of SEQ ID NO:2 or about amino acids 1-530 of SEQ ID NO:25, in E. coli according to methods known in the art. Alternatively, the Delta3 protein fragment can be about amino acid 173 to about amino acid 517 of SEQ ID NO:2 or from about amino acid 174 to about amino acid 508 of SEQ ID NO:25. Similarly, a Delta3 binding fragment of a Delta3 binding protein (i.e., Delta3 binding partner) can be produced recombinantly.

A Delta3 binding protein can be a Notch protein and can be identified, e.g., by determining whether the protein is capable of binding to a Delta3 protein. A nucleic acid encoding a Notch protein can be obtained, e.g., by PCR amplifying a portion of a Notch gene encoding at least an EGF-like domain, using primers having a nucleotide sequence derived from the nucleotide sequence of a Notch gene present in GenBank or disclosed in PCT Application NO: PCT/US92/03651 or PCT/US93/09338.

Test compounds can then be tested to determine whether they inhibit the interaction between the Delta3 and the Delta3 binding protein by using an ELISA type assay. Accordingly, one of the recombinantly produced Delta3 protein and the Delta3 binding protein, e.g., Notch protein, is attached to a solid phase surface and the other protein is labeled, e.g., such as by tagging the protein with an epitope, for which an antibody is available (e.g., FLAG epitope, available from International Biotechnologies, Inc.). As a non-limiting example of an assay, the Delta3 protein can be linked to the wells of a microtiter (96 well) plate by overnight incubation of the protein at a concentration of 10 µg/ml in PBS. After blocking unoccupied sites on the plate with a BSA solution, various amounts of test compounds and the recombinantly produced Delta3 binding protein are added to the wells in a buffer suitable for a specific interaction between the proteins.

After an incubation time of several hours, the wells are rinsed with buffer, and the amount of Delta3 binding protein attached to the wells is determined. The amount of bound protein can be determined by incubating the wells with an anti-tag, e.g., anti-myc, antibody, which can then be detected by enzyme immunoassay. The amount of bound protein is then determined by determining the optical density using an ELISA reader. A lower amount of Delta3 binding protein in a well that contained a test compound relative to a well that did not contain a test compound is indicative that the test compound inhibits the interaction between Delta3 and a Delta3 binding protein.

In a further non-limiting example of a binding assay, a recombinantly produced and labeled Delta3 polypeptide, or fragment thereof capable of binding a Delta3 binding protein, is incubated, with or without a test compound, with cells expressing the Delta3 binding protein (Shimizu et al. (1999) J. Biol. Chem. 274:32961-32969). Alternatively, the recombinant Delta3 polypeptide is not labeled and is detected upon binding the cell by a second Delta3 binding protein, such as an antibody. A lower amount of Delta3 binding protein in a well that contained a test compound relative to a well that did not contain a test compound is indicative that the test compound inhibits the interaction between Delta3 and a Delta3 binding protein.

A Delta3 therapeutic can also be identified by using a reporter assay in which the level of expression of a reporter construct under the control of a Delta3 promoter is measured in the presence or absence of a test compound. A Delta3 promoter can be isolated by screening a genomic library with a Delta3 cDNA which preferably contains the 5' end of the cDNA. A portion of the Delta3 promoter, typically from about 50 to about 500 base pairs long is then cloned upstream of a reporter gene, e.g., a luciferase gene, in a plasmid. This reporter construct is then transfected into cells, e.g., neural cells or endothelial cells. Transfected cells are then be distributed into wells of a multiwell plate and various concentrations of test compounds are added to the wells. After several hours incubation, the level of expression of the reporter construct is determined according to methods known in the art. A difference in the level of expression of the reporter construct in transfected cells incubated with the test compound relative to transfected cells incubated without the test compound will indicate that the test compound is capable of modulating the expression of the Delta3 gene and is thus a Delta3 therapeutic.

Example 9

Isolation and Characterization of Human FTHMA-070 cDNAs

The nucleic acid molecule encoding FTHMA-070 was identified during the sequencing of clones present in a cardiac coronary artery smooth muscle cell library. A clone was identified which appeared to have some homology to TNF receptor. This clone proved to encode FTHMA-070. The nucleic acid sequence and deduced amino acid sequence of FTHMA-070, which has homology to tumor necrosis factor receptor (including the death domain) are shown in SEQ ID NO:53 and SEQ ID NO:54, respectively.

Example 10

Characterization of FTHMA-070 Proteins

The human FTHMA-070 cDNA isolated as described above (SEQ ID NO:53) encodes a 401 amino acid protein (SEQ ID NO:54). FTHMA-070 is predicted to include a 21 amino acid signal peptide (amino acid 1 to about amino acid 21 of SEQ ID NO:54) preceding the 380 mature protein (about amino acid 22 to amino acid 401; SEQ ID NO:56).

Example 11

Preparation of FTHMA-070 Proteins

Recombinant FTHMA-070 can be produced in a variety of expression systems. For example, the mature FTHMA-070 peptide can be expressed as a recombinant glutathione-S-transferase (GST) fusion protein in E. coli and the fusion protein can be isolated and characterized. Specifically, as described above, FTHMA-070 can be fused to GST and this fusion protein can be expressed in E. coli strain PEB 199. Expression of the GST-FTHMA-070 fusion protein in PEB 199 can be induced with IPTG. The recombinant fusion protein can be purified from crude bacterial lysates of the induced PEB 199 strain by affinity chromatography on glutathione beads.

Example 12

Isolation and Characterization of Human FTHMA-070 cDNAs

The nucleic acid molecule encoding T85 (originally called FMHB-6D4 and FMHB-SD4) was identified using a screen designed to identify genes encoding proteins having a functional signal sequence. Briefly, a library was prepared in which each of the clones contained a human fetal brain cDNA ligated to a sequence encoding a detectable protein which lacked a signal sequence. If the human fetal cDNA encodes a functional signal sequence, it will permit the secretion and detection of the detecable protein. This clone library was used to transfect mammalian cells. Clones which secreted the detectable protein were then identified and the corresponding human fetal brain cDNA was isolated and sequenced using standard techniques. In this way it was possible to identify a clone encoding T85. The nucleic acid sequence and deduced amino acid sequence of T85 are shown in SEQ ID NO:57 and SEQ ID NO:58, respectively.

Example 13

Characterization of T85 Proteins

The human T85 cDNA isolated as described above (SEQ ID NO:57) encodes a 753 amino acid protein (SEQ ID NO:58). The signal peptide prediction program SIGNALP (Nielsen et al. (1997) *Protein Engineering* 10:1-6) predicted that T85 includes a 20 amino acid signal peptide (amino acid 1 to about amino acid 20 of SEQ ID NO:58) preceding the 733 amino acid mature protein (about amino acid 21 to amino acid 753 of SEQ ID NO:58; SEQ ID NO:60). For general information regarding PFAM identifiers and Hidden Markov Model (HMM) consensus sequences refer to Sonnhammer et al. (1997) *Protein* 28:405-420.

T85 has a two regions (amino acids 525-610 and 638-727 of SEQ ID NO:58; SEQ ID NO:61 and SEQ ID NO:62, respectively) of homology to a fibronectin type III domain (based on HMM PF00041; SEQ ID NO:70). Also, T85 has a five regions (amino acids 43-101; 145-203; 237-298; 329-394; and 433-491 of SEQ ID NO:58; SEQ ID NOs:63-67) of homology to a Ig superfamily domain. T85 also includes an RGD motif starting at amino acid 247 of SEQ ID NO:58; a cytokine receptor homolgy N-terminal (BC) domain (CC—CC) at amino acids 516-600 of SEQ ID NO:58.

Example 14

Preparation of T85 Proteins

Recombinant T85 can be produced in a variety of expression systems. For example, the mature T85 peptide can be expressed as a recombinant glutathione-S-transferase (GST) fusion protein in *E. coli* and the fusion protein can be isolated and characterized. Specifically, as described above, FTHMA-070 can be fused to GST and this fusion protein can be expressed in *E. coli* strain PEB199. Expression of the GST-T85 fusion protein in PEB 199 can be induced with IPTG. The recombinant fusion protein can be purified from crude bacterial lysates of the induced PEB 199 strain by affinity chromatography on glutathione beads.

Example 15

T85 exhibits considerable homology to human Robo protein (Kidd et al. (1997) *Cell* 92:205-215), an axon guidance receptor that is thought to play an important role in neuronal development, specifically, control of midline crossing. Accordingly, T85 may also play a role in neuronal development. Thus, T85 nucleic acids, polypeptides, T85 agonists, and T85 antagonists may be useful in the treatment of neurological disorders.

Example 16

Isolation and Characterization of Human Tango-77 cDNAs

Cytokine genes IL-1α, IL-1β and IL-1ra have been found to be closely clustered on chromosome 2, i.e., IL-1α, IL-1β and IL-1ra are located within 450 kb of each other. BAC clones containing IL-1α and IL-1β were used to identify other proximal unknown cytokine genes. To do this, a BAC clone containing IL-1α and IL-1β was selected from a BAC library (Research Genetics, Huntsville, Ala.) using specific primers designed against IL-1α and IL-1β. The DNA from the BAC was extracted and used to make a random-sheared genomic library. From this BAC library, 4000 clones were selected for sequencing. The resulting genomic sequences were then assembled into contigs and used to screen proprietary and public data bases. One genomic contig was found to contain two segments of sequences which resemble IL-1ra. These two segments are potential exons of Tango-77 gene.

Two PCR primers were then designed from the two potential exons and used to screen a panel of cDNA libraries for the expression of a Tango-77 message. A cDNA library from TNF-α treated human lung epithelia showed a positive band of the predicted size (i.e., if the two exons are spliced together). Using the PCR fragment as a probe, a single cDNA clone was isolated from the same library. This cDNA contains an insert of 989 bp. The cDNA clone contains three possible open reading frames. The first open reading frame encompasses 534 nucleotides (nucleotides 356-889 of SEQ ID NO:71; SEQ ID NO:73) and encodes a 178 amino acid protein (SEQ ID NO:72). This protein may include a predicted signal sequence of about 63 amino acids (from amino acid I to about amino acid 63 of SEQ ID NO:72 (SEQ ID NO:74)) and a predicted mature protein of about 115 amino acids (from about amino acid 64 to amino acid 178 of SEQ ID NO:72 (SEQ ID NO:75)).

The second putative nucleotide open reading frame encompasses 498 nucleotides (nucleotides 389-889 of SEQ ID NO:71; SEQ ID NO:76) and encodes a 167 amino acid protein (SEQ ID NO:77). This protein includes a predicted signal sequence of about 52 amino acids (from amino acid 1 to about amino acid 52 of SEQ ID NO:77 (SEQ ID NO:78)) and a predicted mature protein of about 115 amino acids (from about amino acid 53 to amino acid 167 of SEQ ID NO:77 (SEQ ID NO:79)).

The third open reading frame (nucleotides 372-889 of SEQ ID NO:71; SEQ ID NO:80) encompasses 408 nucleotides and encodes a 136 amino acid protein (SEQ ID NO:81). This protein includes a predicted signal sequence of about 21 amino acids (from amino acid 1 to about amino acid 21 of SEQ ID NO:81 (SEQ ID NO:82)) and a predicted mature protein of about 115 amino acids (from about amino acid 22 to amino acid 136 of SEQ ID NO:81 (SEQ ID NO:83)).

Tango-77 is predicted to be 35% identical to human IL-1ra at the amino acid level.

Example 17

Expression of Tango-77 mRNA in Human Tissues

The expression of Tango-77 was analyzed using Northern blot hybridization. A PCR generated 989 bp Tango-77 product was radioactively labeled with $^{32}$P-dCTP using the Prime-It kit (Stratagene; La Jolla, Calif.) according to the instructions of the supplier. Filters containing human mRNA (MTNI and MTNII: Clontech; Palo Alto, Calif.) were probed in ExpressHyb hybridization solution (Clontech) and washed at high stringency according to manufacturer's recommendations.

Tango-77 mRNA was not detected in any unstimulated tissues (brain, liver, spleen, skeletal muscle, testis, pancreas, heart, kidney and peripheral blood leukocytes) mRNA on Clontech Northern blots.

Over 96 cDNA libraries were then tested for the presence of Tango-77 using PCR amplification. Only three libraries displayed a positive signal. These libraries were the TNFα-treated bronchoepithelium, TNFα-treated SSC cell line and anti-CD3-treated T cells.

Example 18

Characterization of Tango-77 Proteins

In this example, the predicted amino acid sequence of human Tango-77 protein was compared to the amino acid sequence of known protein IL-1ra. In addition, the molecular weight of the human Tango-77 proteins was predicted.

The human Tango-77 cDNA (SEQ ID NO:71) isolated as described above encodes a 178 amino acid protein (SEQ ID NO:72) or a 167 amino acid protein (SEQ ID NO:77) or a 136 amino acid protein (SEQ ID NO:81). The signal peptide prediction program SIGNALP Optimized Tool (Nielsen et al. (1997) *Protein Engineering* 10:1-6) predicted that Tango-77 includes a 63 amino acid signal peptide (amino acid 1 to about amino acid 63 of SEQ ID NO:72 (SEQ ID NO:74)) preceding the 115 mature protein; or preceding the 115 mature protein (about amino acid 52 to amino acid 167 of SEQ ID NO:77 (SEQ ID NO:78)); or preceding the 115 mature protein (about amino acid 21 to amino acid 136 of SEQ ID NO:81; SEQ ID NO:82).

As shown in FIG. 1, Tango-77 has a region of homology to IL-1ra (SEQ ID NO:84).

Mature Tango-77 has a predicted MW of about 13 kDa and the predicted MW for the immature Tango-77 is 19.6 kDa, 18.5 kDa or 15.2 kDa, not including post-translational modifications.

Example 19

Preparation of Tango-77 Proteins

Recombinant Tango-77 can be produced in a variety of expression systems. For example, the mature Tango-77 peptide can be expressed as a recombinant glutathione-S-transferase (GST) fusion protein in *E. coli* and the fusion protein can be isolated and characterized. Specifically, as described above, Tango-77 can be fused to GST and this fusion protein can be expressed in *E. coli* strain PEB199. Expression of the GST-Tango-77 fusion protein in PEB199 can be induced with IPTG. The recombinant fusion protein can be purified from crude bacterial lysates of the induced PEB199 strain by affinity chromatography on glutathione beads.

Example 20

Alternatively Spliced Forms of IL-1ra and Tango-77

Computer program Procrustes (Gelfand et al., 1996, *Proc. Natl. Acad. Sci. USA,* 93:9061-9066) is an alignment algorithm that predicts the presence of alternatively spliced exons for a protein of interest in a stretch of genomic DNA. Using the IL-1ra sequence, Proscustes was used to search for the presence of additional sequences that might encode for alternatively spliced forms of IL-1ra in the two overlapping BAC genomic sequences. Potential sequences that encode variant exons for IL-1ra were identified. These predicted exons aligned well with the N-terminal region of IL-1ra, but were not present in Tango-77. The results from Procrustes predicts the existence of more spliced forms of IL-1ra.

Furthermore, Procrustes also predicted an additional sequence in BAC1 (SEQ ID NO:86) and BAC2 (SEQ ID NO:87) that encodes an alternatively spliced exon for Tango-77 (T77-procrustes). This predicted splice variant form of Tango-77, T77-procrustes, was aligned with Tango-77 and with IL-1ra and IL-1P.

PCR primers within this sequence can be used to generate a product that can be used to screen a panel of cDNA libraries using standard techniques. Suitable cDNA libraries include libraries made from TNFα-treated bronchoepithelium, TNFα-treated SSC cell line and anti-CD3-treated T cells. The resulting cDNA clone(s) can be isolated from the library and sequenced to identify additional Tango-77 cDNAs.

Example 21

Isolation and Characterization of Human and Murine SPOIL cDNAs

In this example, the isolation of the genes encoding human and murine SPOIL proteins (also referred to as "TANGO 080" proteins) are described.

Isolation of Murine SPOIL-I and SPOIL-II cDNAs

A murine SPOIL-I cDNA was identified by searching with a murine cDNA encoding an IL-1 signature region (Prosite™ Accession Number PDOC00226) against a copy of the GenBank nucleotide database using the BLASTN™ program (BLASTN 1.3 MP: Altschul et al., J. Mol. Bio. 215:403, 1990). A clone with 48% homology with the murine cDNA IL-1 signature region was found by this search. The sequence was analyzed against a non-redundant protein database with the BLASTX™ program, which translates a nucleic acid sequence in all six frames and compares it against available protein databases (BLASTX 1.3 MP:Altschul et al., supra). This protein database is a combination of the SwissProt, PIR, and NCBI GenPept protein databases. One clone was obtained from the IMAGE consortium, and fully sequenced. The additional sequencing of this clone extended the original EST by 267 nucleotides at both the 5' and 3' ends. The cDNA for this clone is approximately 746 nucleotides in length and has an open reading frame of 297 nucleotides that is predicted to encode a protein of 98 amino acids.

The original first pass sequence of the clone showed homology to horse IL-1ra and murine IL-1ra using the BLASTX™ program. The nucleotide sequence and predicted amino acid sequences are shown in SEQ ID NO:89 and SEQ ID NO:90, respectively. The murine SPOIL-1 protein (corresponding to amino acids 1-98 of the predicted amino acid sequence, SEQ ID NO:90) shows 37.0% identity to the horse IL-1ra protein and 39.0% identity to the murine IL-1ra protein.

Alignment of murine SPOIL-I protein with murine IL-1α (SwissProt™ Accession Number P01582) and murine IL-1β (SwissProt™ Accession Number P10749) indicates the presence of an aspartic acid at amino acid residue 91 of SEQ ID NO:90 and amino acid residue 74 of SEQ ID NO:93 which corresponds to an aspartic acid found at amino acid residue 266 of murine IL-1α and amino acid residue 261 of murine IL-1β. In addition, alignment of murine SPOIL-I with murine IL-1ra indicates that this aspartic acid residue of SPOIL-I corresponds with a lysine at amino acid residue 171 of murine IL-1ra (or amino acid residue 145 of mature murine IL-1ra) which has been shown to convert IL-1ra into an agonist by mutating this lysine residue to an aspartic acid residue. (Ju et al. (1991) *Proc. Natl. Acad. Sci. USA* 88:2658-2662).

This murine SPOIL-I protein contains an IL-1 signature domain (corresponding to amino acids 58-80 of the predicted amino acid sequence, SEQ ID NO:90 and amino acids 41-63 of SEQ ID NO:93) and a signal sequence (corresponding to amino acids 1-17 of the predicted amino acid sequence, SEQ ID NO:90) which is cleaved to form a mature SPOIL-I protein (corresponding to amino acids 1-81 of SEQ ID NO:93). The predicted molecular weight for the 98 amino acid SPOIL-1 is approximately 10.96 kDa and the predicted molecular weight for mature SPOIL-I (SEQ ID NO:93) is approximately 9.1 kDa.

A GenBank™ search using the murine SPOIL nucleotide sequence of SEQ ID NO:89 revealed a human EST (W78043) which was similar to a region of the nucleotide sequence of SEQ ID NO:89. As no reading frame can be determined from an EST (such as the EST identified in the above database search) an amino acid sequence encoded by an EST can not be determined.

The entire cDNA of mouse SPOIL-I was used as a probe to screen a mouse esophagus library to search for alternate SPOIL transcripts. A second form of mouse SPOIL was isolated and sequenced. This second form encodes a protein of 160 amino acid residues that lacks a signal peptide. Accordingly, this isoform, designated murine SPOIL-II is predicted to be an intracellular protein. Alignment of the 2 mouse SPOIL proteins shows that they are identical at the C-terminus but have differing N-termini. For example, murine SPOIL-I and SPOIL-II exhibit 100% identity when amino acid residues 29-98 of murine SPOIL-I are aligned to amino acid residues 91-160 of murine SPOIL-II. It is predicted that the two isoforms of murine SPOIL are splice variants of the murine SPOIL gene.

A global alignment of murine SPOIL-I (SEQ ID NO:90) with murine SPOIL-II (SEQ ID NO:113) using the ALIGN program version 2.0 (global alignment program, Myers and Miller, CABIOS, 1989) using a PAM120 weight residue table, a gap length penalty of 12 and a gap penalty of 4 indicated that the proteins are 46.3% identical over the entire length of the sequences.

Isolation of Human SPOIL-I and SPOIL-II cDNAs

A cDNA library was constructed using mRNA isolated from near confluent monolayers of human keratinocytes (Clonetics™) which had been stimulated with 50 ng/ml PMA, 1 μg/ml ionomycin, 10 ng/ml TNF, and 40 μg/ml cycloheximide for 4 hours. EST sequencing information was gathered to create a proprietary database of information describing the keratinocyte cDNA clones. Three clones were identified by performing a TBLASTN search of the proprietary EST database using the sequence of murine SPOIL-I as a query sequence (the three clones having a probability score of at least 1.4e-48).

The nucleotide sequence and predicted amino acid sequences of human SPOIL-I are shown in SEQ ID NO:101 and SEQ ID NO:102, respectively. The nucleotide sequence and predicted amino acid sequences of human SPOIL-II are shown in SEQ ID NO:104 and SEQ ID NO:105, respectively. A global alignment of human SPOIL-I (SEQ ID NO:102) with human SPOIL-II (SEQ ID NO: 105) using the ALIGN program version 2.0 (global alignment program, Myers and Miller, CABIOS, 1989) using a PAM120 weight residue table, a gap length penalty of 12 and a gap penalty of 4 indicated that the proteins are 80.8% identical over the entire length of the sequences.

As was the case with the two murine isoforms of SPOIL, the two human SPOIL isoforms exhibit exact identity at the C-terminus and are variant at their N-termini. Human SPOIL-II has an insertion of 40 amino acid residues close to the N-terminus of the protein which are not present in human SPOIL-I. Like murine SPOIL-II, both human SPOIL isoforms lack a signal sequence, and accordingly, are predicted to be intracellular proteins. Human SPOIL-I and SPOIL-II may be splice variants of a common gene. An alignment of human SPOIL-I (SEQ ID NO:102) with murine SPOIL-I (SEQ ID NO:90) using the ALIGN program (parameters set as described for the alignment of human SPOILs I and II) indicated that the proteins are 26.3% identical over the entire length of the sequences, e.g., global alignment. Moreover, using the same program and parameters, it was determined that the nucleic acids which encode murine SPOIL-I (SEQ ID NO:89) and human SPOIL-II (SEQ ID NO:101) are 39.8% identical at the nucleotide level. An alignment of human SPOIL-II (SEQ ID NO:105) with murine SPOIL-II (SEQ ID NO:113) using the ALIGN program (parameters set as described above) indicated that the proteins are 37.3% identical over the entire length of the sequences, e.g., global alignment.

When locally aligned, the identity between the four SPOIL proteins described above is significant. TABLE VII sets forth the % identity among SPOIL family members (when the C-terminal unique domains of each family member are compared). Moreover, TABLE VII sets forth the % identity between each SPOIL C-terminal unique domain and murine IL-1ra. The alignment was performed using the Lipman-Pearson Algorithm (Lipman et al. (1985) *Science* 227:1435-1441), with a K-tuple of 2, a Gap Penalty of 4, and a Gap Weight Penalty of 12.

TABLE VII

|  | muSPOIL-I | muSPOIL-II | huSPOIL-I | huSPOIL-II | muIL-1ra |
| --- | --- | --- | --- | --- | --- |
| muSPOIL-I | 100 | | | | |
| muSPOIL-II | 97.1 | 100 | | | |
| huSPOIL-I | 52.2 | 53.6 | 100 | | |
| huSPOIL-II | 52.2 | 53.6 | 100 | 100 | |
| muIL-ra | 36.2 | 37.7 | 39.7 | 39.7 | 100 |

Alignment of the four SPOIL family members resulted in the generation of at least two SPOIL consensus motifs, due to the highly conserved nature of specific amino acid residues among the family members. The SPOIL consensus motifs ("SPOIL signature motifs") are set forth as SEQ ID NOs:110-111 (SEQ ID NO:110 corresponds to the short SPOIL signature motif and SEQ ID NO:111 corresponds to the long SPOIL consensus motif). Short and long SPOIL consensus motifs are found, for example, from amino acid residues 26-69 and 26-93 of muSPOIL-I, from residues 88-131 and 88-155 of muSPOIL-II, from residues 98-141 and 98-164 of huSPOIL-I, and from residues 137-180 and 137-203 of huSPOIL-II.

Further alignment of the intracellular SPOIL isoforms indicates that the proteins have at least 50% identity among the SPOIL unique domains of the proteins. TABLE VIII sets forth the % identity among SPOIL family members (when the SPOIL unique domains of each family member are compared). The alignment was performed using the Lipman-Pearson Algorithm (Lipmanet al. (1985) *Science* 227:1435-1441), with a K-tuple of 2, a Gap Penalty of 4, and a Gap Weight Penalty of 12.

TABLE VIII

|  | muSPOIL-II | huSPOIL-I | huSPOIL-II |
|---|---|---|---|
| muSPOIL-II | 100 | | |
| huSPOIL-I | 50.3 | 100 | |
| huSPOIL-II | 50.3 | 100 | 100 |

Example 22

Distribution and Expression of SPOIL-I mRNA in Mouse and Human Tissues In Situ Hybridization Analysis of Mouse Tissues In situ analysis revealed the following expression patterns when tissue sections were hybridized with SPOIL-I probes. SPOIL-I mRNA was expressed almost exclusively in the squamous epithelium of the esophagus in both adult and embryonic mouse tissues. SPOIL-I mRNA was also expressed in the epithelial lining of the mouth in adult mouse tissues and embryonic mouse tissues.

Moreover, in situ analysis of tissue samples for mice which had been intravenously injected with 20 mg/kg of lippopolysaccharide (LPS) revealed that SPOIL-I expression was induced in the kidney.

Northern Blot Analysis of Human Tissues

Northern blot analysis of human tissues confirmed the pattern of SPOIL expression with SPOIL-I transcripts being detected in esophagus and, likely, trachea, among the tissues tested. In addition, SPOIL-I was also present on human esophageal tumor samples and overexpressed in moderately differentiated squamous cell carcinoma of the esophagus.

Expression of SPOIL in Human and Mouse Cell Lines

Human SPOIL-I expression was induced in keratinocytes (Clonetics) 2 hours following induction with 50 ng/ml PMA, 1ug/mL ionomycin, 10 ng/ml TNF and 40 ug/mL cyclohexamide. No expression was observed in unstimulated cultures.

Moreover, inducible expression of mouse SPOIL-I was observed in the monocytic cell line J774, 24 h after treatment with 0.1 µg/ml LPS.

Example 23

Expression of Recombinant SPOIL-I Protein in Bacterial Cells

SPOIL can be expressed as a recombinant glutathione-S-transferase (GST) fusion polypeptide in *E. coli* and the fusion polypeptide can be isolated and characterized. Specifically, SPOIL is fused to GST and this fusion polypeptide is expressed in *E. coli*, e.g., strain PEB199. As, for example, the murine SPOIL-I protein is predicted to be approximately 9.1 kDa and the GST is predicted to be approximately 26 kDa, the fusion polypeptide is predicted to be approximately 35.1 kDa in molecular weight. Expression of the GST-SPOIL-I fusion protein in PEB199 is induced with IPTG. The recombinant fusion polypeptide is purified from crude bacterial lysates of the induced PEB 199 strain by affinity chromatography on glutathione beads. Using polyacrylamide gel electrophoretic analysis of the polypeptide purified from the bacterial lysates, the molecular weight of the resultant fusion polypeptide is determined.

Example 24

Expression of Recombinant SPOIL Proteins in COS Cells

To express the murine SPOIL-I gene, for example, in COS cells, the pcDNA/Amp vector by Invitrogen Corporation (San Diego, Calif.) is used. This vector contains an SV40 origin of replication, an ampicillin resistance gene, an *E. coli* replication origin, a CMV promoter followed by a polylinker region, and an SV40 intron and polyadenylation site. A DNA fragment encoding the entire SPOIL-I protein and a HA tag (Wilson et al. (1984) *Cell* 37:767) fused in-frame to its 3' end of the fragment is cloned into the polylinker region of the vector, thereby placing the expression of the recombinant protein under the control of the CMV promoter.

To construct the plasmid, the SPOIL-I DNA sequence is amplified by PCR using two primers. The 5' primer contains the restriction site of interest followed by approximately twenty nucleotides of the SPOIL-I coding sequence starting from the initiation codon; the 3' end sequence contains complementary sequences to the other restriction site of interest, a translation stop codon, the HA tag and the last 20 nucleotides of the SPOIL-I coding sequence. The PCR amplified fragment and the pcDNA/Amp vector are digested with the appropriate restriction enzymes and the vector is dephosphorylated using the CIAP enzyme (New England Biolabs, Beverly, Mass.). Preferably the two restriction sites chosen are different so that the SPOIL-I gene is inserted in the correct orientation. The ligation mixture is transformed into *E. coli* cells (strains HB101, DH5a, SURE, available from Stratagene Cloning Systems, La Jolla, Calif., can be used), the transformed culture is plated on ampicillin media plates, and resistant colonies are selected. Plasmid DNA is isolated from transformants and examined by restriction analysis for the presence of the correct fragment.

COS cells are subsequently transfected with the SPOIL-I-pcDNA/Amp plasmid DNA using the calcium phosphate or calcium chloride co-precipitation methods, DEAE-dextran-mediated transfection, lipofection, or electroporation. Other suitable methods for transfecting host cells can be found in Sambrook, J., Fritsh, E. F., and Maniatis, T. *Molecular Cloning: A Laboratory Manual.* 2nd, ed., Cold Spring Harbor Laboratory, Cold Spring Harbor Laboratory Press, Cold Spring Harbor, N.Y., 1989. The expression of the SPOIL-I protein is detected by radiolabelling ($^{35}$S-methionine or $^{35}$S-cysteine available from NEN, Boston, Mass., can be used) and immunoprecipitation (Harlow, E. and Lane, D. *Antibodies: A Laboratory Manual*, Cold Spring Harbor Laboratory Press, Cold Spring Harbor, N.Y., 1988) using an HA specific monoclonal antibody. Briefly, the cells are labeled for 8 hours with $^{35}$S-methionine (or $^{35}$S-cysteine). The culture media are then collected and the cells are lysed using detergents (RIPA buffer, 150 mM NaCl, 1% NP-40, 0.1% SDS, 0.5% DOC, 50 mM Tris, pH 7.5). Both the cell lysate and the culture media are precipitated with an HA specific monoclonal antibody. Precipitated proteins are then analyzed by SDS-PAGE.

Alternatively, DNA containing the SPOIL-I coding sequence is cloned directly into the polylinker of the pcDNA/Amp vector using the appropriate restriction sites. The resulting plasmid is transfected into COS cells in the manner described above, and the expression of the SPOIL-I protein is detected by radiolabelling and immunoprecipitation using a SPOIL-I specific monoclonal antibody Example 25

Retroviral Delivery of SPOIL Proteins

Full length SPOIL-I genes were expressed in vivo by retroviral-mediated infection. In this example, the sequence for murine SPOIL-I (amino acids 1-98) was amplified using the following primers;

```
Forward Primer (SEQ ID NO: 96):
5' AAAAAAGAAT TCGCCACCAT GTTCAGGATC TTTA 3'

Reverse Primer (SEQ ID NO: 97):
5' TCCTCTGTCG ACTCACTTGT CGTCGTCGTC CTTGTAGTCA

TGTACCACAA TCAT 3'
```

The reverse primer placed an epitope tag (Flag sequence) on the 3' end of the protein. Amplified products were then subcloned into the retroviral vector MSCVneo (Hawley et al. (1994) *Gene Therapy* 1:136-138), and sequence verified. Bone marrow from 5-fluorouracil treated mice infected with the retrovirus was then transplanted into irradiated mouse recipients and the pathology was reviewed after 5 weeks.

The spleen and bones of the mouse recipients were taken 5 weeks after transplantation. Disassociated spleen cells, which are a source of osteoclast progenitors, from the SPOIL-I infected mice were plated on top of ST2 bone marrow stromal line in the presence of 1, 25 dihydroxy vitamin D3 as described by Lacey et al. (1995) *Endocrinology* 136:2367-2376 and Udagawa et al. (1989) *Endocrinology* 125:1805-1813. In addition, spleen cells from control mice transplanted with marrow infected with retrovirus without the inserted SPOIL-I gene, were plated. After nine days of culture, the number of osteoclasts was determined by staining for tartrate resistant acid phosphatase (TRAP).

The results of these experiments demonstrated that the number of TRAP positive osteoclasts was dramatically decreased in cultures with the SPOIL-I infected spleen cells as compared to the control cells. Histologically, the bones of mice recipients transplanted with SPOIL-I infected marrow, also appeared to be thicker than the bones of the corresponding control mice. Generally, there was less trabecular bone at the growth plate. The trabecular bone was compressed and thickened with more osteoid formation and more osteoblasts present.

Example 26

Identification And Characterization of NEOKINE-1 cDNAs

In this example, the identification and characterization of the genes encoding human, murine, rat and macaque NEOKINE-1 (also referred to as "ANTIKINE-1", "TANGO 112", or T112) is described.

Isolation of the Murine and Human NEOKINE-1 cDNAs

The invention is based, at least in part, on the discovery of the murine and human genes encoding a novel protein, referred to herein as NEOKINE-1. In order to identify potentially novel chemokines, using an automated procedure, the human amino acid sequences of the chemokines, interleukin-8, gamma-IP10, Sis-Delta, fractalkine, and SDF-1 were used to search proprietary databases and the dbEST databases using TBLASTN (Wash U. version, 2.0, BLOSUM62 search matrix). Sequences exhibiting 90% or greater identity to any protein present in Genpept, SwissProt, or PIR were marked as examples of these proteins and removed. This analysis identified a mouse EST (accession number AA013634) potentially encoding a chemokine. As the encoded protein was quite divergent from all other chemokine family members, and the open reading frame constituted a small percentage of the total cDNA length (see below), to establish whether this transcript encoded a novel chemokine family member, the nucleotide sequence of the entire cDNA was determined. To do this, first, additional ESTs from the mouse gene were retrieved from public databases by similarity searches. A total of 33 murine sequences were thus retrieved. Second, these sequences were used to create an extensive length of continuous sequence (contig). The 33 murine ESTs were aligned and edited at discrepant bases into a single contig of 1420 bp. The 5' end of the contig appeared to be missing part of the open reading frame. To extend this sequence, the sizes of the inserts of several of the murine cDNA clones from which the ESTs were derived was determined and one with the largest insert (about 1.45 kb) was subsequently re-sequenced in its entirety. This extended the sequence by 5 bp to 1425 bp and corrected some remaining discrepancies.

72 human ESTs from a presumptive human orthologue of the above-described mouse gene were identified. However, these ESTs, after a similar assembly and editing, aligned into two non-overlapping contigs of 364 and 1101 bp. Comparison with the murine sequence suggested that the 364-bp contig derived from the 5' part of the human gene, while the 1101-bp contig derived from the 3' part of the human gene and included the poly(A) tail. The distribution of 5' EST reads implied that there was no cDNA clone which contained both halves of the gene. At the 3' end of the 5' contig, there was a naturally occurring run of adenosine nucleotides (see below), to which the oligo-d(T) primer used in reverse transcription would have annealed (i.e., this primer would have annealed at two sites: the actual poly (A) tail and this internal oligo (A) stretch). This ectopic primer would have blocked reverse transcription in the human sequence at about 1.1 kb from the 3' end, but also would have allowed a second set of cDNA molecules to be synthesized which covered the 5' end of the gene. The two human EST contigs that can be derived from these 72 ESTs therefore would appear on inspection and in the absence of further information, to derive from two genes instead of one. That this is the case is shown by the fact that automated assembly of ESTs produced distinct "UniGene" numbers for the two contigs (Hs.21210 for the 5' contig and Hs.24395 for the 3' contig).

To establish that the two human contigs derived from the same transcript, two primers lacking oligo d(T) were designed from the two assembled human contigs such that they would amplify an ~300 bp fragment spanning the contigs. Using first-strand cDNA prepared from human placental poly (A)+ RNA, a unique ~300 bp fragment aws amplified by standard techniques. This cDNA was subsequently cloned and sequenced. The sequence did span the two contigs and provided the missing sequence between them. The primers were h112/227f (CCAAGCGCTTCATCAAGTGG) (SEQ ID NO:125) and h112/526r (GCAGCCTGTGAT-GAAGTCTGG) (SEQ ID NO:126).

The 5' end of the contig, which included part of the open reading frame, was missing from the assembled single contig. To obtain the complete transcript sequence at the 5' end for the human gene, a cDNA clone (rthp112) extending from the 5' end of the human transcript to beyond the end of the open reading frame was generated by the RACE procedure. The gene-specific primer used was t112racel (CAGCCTATTCT-TCGTAGACCCTGC) (SEQ ID NO:127). The 5'-most 35 bp of this clone formed a palindrome and thus appeared to be a cloning artifact, as is well known in the art, and was removed from the final sequence. The remaining sequence extended the human cDNA sequence by 108 bp to 1564 bp and corrected some remaining discrepancies. Clone rthp112, comprising the entire coding region of human NEOKINE-1 has been deposited with the ATTC and has Accession No. 98751.

The nucleotide sequence encoding the human NEOK-INE-1 protein is set forth as SEQ ID NO:115. The full length protein encoded by this nucleic acid is comprised of about 99 amino acids and has the amino acid sequence set forth as SEQ ID NO:116. The coding portion (open reading frame) of SEQ ID NO:115 is set forth as SEQ ID NO:117.

To identify a murine cDNA clone containing a near full-length insert, the sizes of the inserts of several of the murine cDNA clones from which the ESTs were derived was determined and one with the largest insert (about 1.45 kb) was subsequently re-sequenced in its entirety. This extended the sequence by 5 bp to 1425 bp and corrected some remaining discrepancies.

The nucleotide sequence encoding the murine NEOK-INE-1 protein is set forth as SEQ ID NO: 118. The full length protein encoded by this nucleic acid is comprised of about 92 amino acids and has the amino acid sequence set forth as SEQ ID NO:119. The coding portion (open reading frame) of SEQ ID NO:118 is set forth as SEQ ID NO:120.

Analysis of Murine and Human NEOKINE-1

Examination of the assembled and corrected cDNA sequences depicted in SEQ ID NO: 115 and SEQ ID NO: 118 showed that they likely encoded highly-conserved proteins, human and mouse NEOKINE-1. Based on the presence of 4 cysteine residues, which presumably form 2 disulfide bonds, a predicted signal sequence, a predicted mature peptide mass of about 10,000 daltons, and a characteristic spacing of one residue between the first two cysteines, it was judged that the encoded protein was a novel member of the alpha chemokine family, and a member of the subfamily that lacked the glutamine-leucine-arginine sequence before the first cysteine. However, three atypical features were also present but conserved between species. These were, first, the presence of an extra 5 residues between the second pair of cysteines; second, the fewest residues before the predicted amino terminus of the mature protein and the first cysteine of any naturally-occurring chemokine; and third, a general dissimilarity to all other chemokines in the region between the second and third cysteines.

A BLAST search (Altschul et al. (1990) J. Mol. Biol. 215:403) of the nucleotide sequence of human NEOKINE-1 has revealed that NEOKINE-1 is significantly similar to a human STS (TIGR-A002114, Accession No. G26440) which was sequenced as part of the WI/MIT human gene mapping project and derived from a TIGR-assembled contig that lacks any of the open reading frame of human NEOKINE-1. (The TIGR-assembled contig failed to reveal the true ORF of human NEOKINE-1, most likely to the existence of a significant number of potential ORFs which fortuitously exist in the long 3' UTR of the human NEOKINE cDNA, but do not, in fact encode the human NEOKINE-1 protein.) The gene is located to human 5q31.1 near the marker D5S396, distinct from the chemokine cluster on chromosome 4q. Plausible human disease genes that map to this region include a hereditary eosinophilia (EOS) and a hereditary high serum IgE associated with hypersuppression of inflammation in the skin (IGES).

The clones of both the human and murine EST sequences used in the assembly of the human and murine contigs derive predominantly from prenatal tissues. In particular, 6 human ESTs derive from clones isolated from neonatal female placenta, 4 human ESTs derive from clones isolated from 8-9-week placenta, 4 human ESTs derive from clones isolated from fetal heart, 4 human ESTs derive from clones isolated from 20-week male liver and spleen, 4 human ESTs derive from clones isolated from breast tumor, 4 human ESTs derive from clones isolated from colon tumor, 3 human ESTs derive from clones isolated from adult breast, 2 human ESTs derive from clones isolated from pregnant uterus, 2 human ESTs derive from clones isolated from endometrial tumor, 1 human EST derives from a clone isolated from fetal brain, 1 human EST derives from a clone isolated from alveolar rhabdomyosarcoma, 1 human EST derives from a clone isolated from ovary tumor, 1 human EST derives from a clone isolated from 8-9-week total fetus, 1 human EST derives from a clone isolated from TIGR placenta II, 1 human EST derives from a clone isolated from corneal stroma, 1 human EST derives from a clone isolated from 3 m muscular atrophy, 1 human EST derives from a clone isolated from thyroid tumor, 1 human EST derives from a clone isolated from a 6-week embryo, and 1 human EST derives from a clone isolated from a 12-week embryo.

11 murine ESTs derive from clones isolated from 13.5+ 14.5d whole embryo, 5 murine ESTs derive from clones isolated from 19.5d embryo, 4 murine ESTs derive from clones isolated from 8.5d embryo, 3 murine ESTs derive from clones isolated from 12.5d embryo, 3 murine ESTs derive from clones isolated from 7d kidney. 2 murine ESTs derive from clones isolated from 13.5+14.5d placenta, 1 murine EST derives from a clone isolated from 6.5/8.5d embryo, 1 murine EST derives from a clone isolated from liver, 1 murine EST derives from a clone isolated from 4-week male thymus, 1 murine EST derives from a clone isolated from diaphragm, and 1 murine EST derives from a clone isolated from 11-week skin.

Tissue Distribution of NEOKINE-1 mRNA

This Example describes the tissue distribution of NEOK-INE mRNA, as determined by Northern blot and in situ hybridization.

Northern blot hybridizations with the various RNA samples were performed under standard conditions and washed under stringent conditions, i.e., 0.2×SSC at 65° C. In each sample, the probe hybridized to a single RNA of about 1.9 kb. The results of hybridization of the probe to various mRNA samples are described below.

Expression in mouse embryos was examined using a developmental mouse Northern (Clontech) and in situ hybridization. This blot had poly(A)+ RNA isolated from whole embryos of age 7, 11, 15 and 17 days. The analysis using the mouse gene as a probe revealed intense expression of a unique 1.9 kb transcript in the 7 d sample, but this may be due to contaminating RNA from the placenta. In the remaining samples, expression was low at 11 d, highest on day 15, and then dropped again on day 17.

Expression in diverse human tissue was examined using tissue-specific Northern blots (Clontech). These blots had poly(A)+ RNA isolated from various disease-free human organs. The analysis using a PCR fragment of the human gene as a probe revealed strongest expression of a unique 1.9 kb transcript in the kidney and small intestine, followed by strong expression in the spleen, uterus and colon, and lower expression in thymus, prostate, stomach, thyroid, spinal cord, lymph node, trachea, adrenal gland, bone marrow, heart, brain placenta, liver, smooth muscle and pancreas. There was little/no expression in lung, peripheral blood leukocytes and testis. The size of the poly(A)+transcript in both human and mouse (1.9 kb) is consistent with the length of the full-length cDNAs (1.56 kb) which lack the poly(A) tails.

In situ hybridization of a murine antisense probe to various embryonic, post-natal and adult tissues was performed as follows. 8 µm sagittal sections of fresh frozen embryonic day 14.5, 16.5 and postnatal day 1.5 B6 mice, as well as 8 µm sections of various adult B6 mouse tissues (listed below) were used for hybridization. Sections were postfixed with 4% formaldehyde in DEPC treated 1× phosphate-buffered saline at room temperature for 10 min before being rinsed twice in DEPC 1× phosphate-buffered saline and once in 0.1 M triethanolamine-HCl (pH 8.0). Following incubation in 0.25% acetic anhydride-0.1 M triethanolamine-HCl for 10 min, sections were rinsed in DEPC 2×SSC (1×SSC is 0.15M NaCl plus 0.015M sodium citrate). Tissue was dehydrated through a series of ethanol washes, incubated in 100% chloroform for 5 min, and then rinsed in 100% ethanol for 1 min and 95% ethanol for 1 min and allowed to air dry.

The hybridization was performed using a $^{35}$S-radiolabeled cRNA (antisense) probe from the following DNA sequence,

```
                                            (SEQ ID NO: 128)
GTCCAAGTGTAAGTGTTCCCGGAAGGGGCCCAAGATCCGCTACAGCGACG

TGAAGAAGCTGGAAATGAAGCCAAAGTACCCACACTGCGAGGAGAAGATG

GTTATCGTCACCACCAAGAGCATGTCCAGGTACCGGGGCCAGGAGCACTG

CCTGCACCCTAAGCTGCAGAGCACCAAACGCTTCATCAAGTGGTACAATG

CCTGGAACGAGAAGCGCAGGGTCTACGAAGAATAGGGTGGACGATCATGG

AAAGAAAAACTCCAGGCCAGTTGAGAGACTTCAGCAGAGGACTTTGCAGA

TTAAAATAAAAGCCCTTTCTTTCTCACAAGCATAAGACAAATTATATATT

GCTATGAAGCTCTTCTTACCAGGGTCAGTTTTTACATTTTATAGCTGTGT

GTGAAAGGCTTCCAGATGTGAGATCCAGCTCGCCTGCGCACCAGACTTCA

TTACAAGTGGCTTTTTGCTGGGCGGTTG.
```

A sense RNA probe made from the same DNA sequence was used to determine specificity of the antisense probe. Tissues were incubated with probes (approximately $5\times10^7$ cpm/ml) in the presence of a solution containing 600 mM NaCl, 10 mM Tris (pH 7.5), 1 mM EDTA, 0.01% sheared salmon sperm DNA, 0.01% yeast tRNA, 0.05% yeast total RNA type X1, 1×Denhardt's solution, 50% formamide, 10% dextran sulfate, 100 mM dithiothreitol, 0.1% sodium dodecyl sulfate (SDS), and 0.1% sodium thiosulfate for 18 h at 55° C. After hybridization, slides were washed with 2×SSC. Sections were then sequentially incubated at 37° C. in TNE (a solution containing 10 mM Tris-HCl (pH 7.6), 500 mM NaCl, and 1 mM EDTA), for 10 min, in TNE with 10 µg of RNase A per ml for 30 min, and finally in TNE for 10 min. Slides were then rinsed with 2×SSC at room temp, washed with 2×SSC at 50° C. for 1 h, washed with 0.2×SSC at 55° C. for 1 h, and 0.2×SSC at 60° C. for 1 h. Sections were then dehydrated rapidly through serial ethanol-0.3 M sodium acetate concentrations before being air dried and exposed to Kodak Biomax MR scientific imaging film for 4 days at room temperature.

Following a 4 day film exposure, NEOKINE mRNA was detectable in the following tissues (Note: Tissues incubated with sense probe showed no signal in any tissues):
Adult Mouse:
Brain—multifocal signal in the cortex
Purkinje cell layer of the cerebellum
areas of the hippocampus and forebrain
a small discrete region in the ventral portion of the hindbrain
low level ubiquitous signal in most other regions
eye—multifocal signal seen in harderian gland
anterior surface of lens/cornea
retina
descending colon—focal signal
transverse/ascending colon—multifocal signal
small Intestine—villi
kidney—cortical region
adrenal gland—medulla region and capsule
heart—multifocal signal
skeletal muscle—multifocal signal
lung—signal outlining the large airways
thymus—low signal
bladder—high signal from the transitional epithelium
placenta—signal seen in the outer membrane/cell layer
The following tissues were tested but no signal was detected in:
spleen
liver
Postnatal Day 1.5 mouse:
brain—specific regions, most notably the cortex
no ubiquitous expression as seen in adult
nasal turbinates
developing upper and lower teeth
trachea
uterus
stemebral cartilage
kidney—medulla and outermost cortex in a multifocal pattern
skin and hair follicles—very strong signal
intestine
note: no signal observed in lung
Embryonic Day 16.5 mouse:
brain—specific regions, most notably the cortex
no ubiquitous expression as seen in adult
spinal cord—low signal
esophagus
lung—signal from large airways
adrenal gland—cortical region (note: opposite of adult)
kidney—medulla and outermost cortex in a multifocal pattern
skin—very strong signal
intestine
Embryonic Day 14.5 mouse:
brain—discrete regions, most notable a region in the hindbrain
lung—signal from large airways
skin—very strong signal especially from whisker pads and tip of nose and tail
umbilical cord
intestine These results reveal a striking distribution of NEOKINE mRNA in various non-lymphoid organs. The fact that many normal tissues express abundant NEOKINE transcript suggests that these tissues make significant quantities of NEOKINE protein and that therefore the pro-inflammatory or chemoattractive activities of NEOKINE are very low or non-existent. Indeed, NEOKINE is expressed most significantly in highly immunoreactive tissues that are involved in barrier functions. This observation is consistent with a proposed role of NEOKINE as a suppressor of inflammation. Furthermore, the predicted amino terminus of mature NEOKINE lies just two residues from the first cysteine. In an analogous situation, an artificially truncated form of human IL-8 with only one residue before the first cysteine instead of the normal 6 residues converts the protein from an agonist to an antagonist of its cognate receptor. These observations are further consistent with the proposed anti-inflammatory activity being mediated by antagonizing the action of other pro-inflammatory chemokines. The general divergence of NEOKINE from other alpha chemokines while being highly conserved itself, and the presence of the extra 5 residues between the second pair of cysteines could also be consistent with a broad antagonist function on a diverse set of chemokine receptors. The strong expression in the skin, the kidney, the bronchii and the brain indicates that NEOKINES have utility in treating inflammation of these organs, such as occurs in acute renal failure, transplantation, allergy and infection. Furthermore, since the human AIDS virus HIV uses some chemokine receptors as co-receptors for infection, NEOKINES may also have utility in slowing or blocking infection by HIV.

Example 27

Isolation And Characterization of Rat and Macaque NEOKINE-1 cDNAs

During routine tests for sequences similar to mouse or human NEOKINE cDNA, one EST deriving from a rat brain cDNA and three ESTs deriving from macaque brain cDNAs were identified in a database of proprietary sequences. The database derives, at least in part, from sequencing of various mammalian clones generated from cDNA libraries created according to routine procedures. The cDNAs originated from rat brain and macaque brain libraries, respectively.

The nucleotide sequence encoding the at least 78 amino acid residues of the rat NEOKINE-1 protein (corresponding to the predicted mature protein) is set forth as SEQ ID NO:121. The amino acid sequence for mature rat NEOKINE-1 is set forth as SEQ ID NO:122. The coding portion (open reading frame) of SEQ ID NO:121 is set forth as SEQ ID NO:123. The nucleotide sequence and predicted amino acid sequence of macaque NEOKINE-1 are set forth as SEQ ID NO:124 and SEQ ID NO:135, respectively.

Examination of the cDNA sequence depicted in SEQ ID NO:121 shows that rat NEOKINE-1 comprises four cysteine residues which are conserved among all NEOKINE-1 family members identified thus far. Structural analysis of these proteins indicates that these cysteines are capable of forming 2 disulfide bridges. FIG. 5 depicts the alignment between the four NEOKINE-1 amino acid sequences identified according to these Examples.

Example 28

Secretion of NEOKINE Chemokines

Expression constructs for RGSHis6 epitope-tagged (C-terminus) human NEOKINE were transfected into 293T cells using lipofectamine (GIBCO/BRL) according to the manufacturers instructions. After culturing in appropriate medium for 48-72 hours, conditioned medium was harvested, spun, filtered, and passed over nickel metal chelating column (Qiagen). After washing, bound material was eluted 200 mM imidazole buffer and fractions collected. Peak fractions were analyzed by SDS-PAGE and western blot using anti His6 antibodies (Quiagen). Purified NEOKINE protein bound to PVDF membrane after SDS-PAGE and electroblotting was sequenced for N-terminal amino acid analysis using Edman-based chemistry protein sequencing. The amino acid residues were analyzed by HPLC and determined by separation and peak height as compared to standards.

The N-terminal sequence of band NEOKINE was found to be SKCKCSRKGP which corresponds exactly to the predicted signal peptide cleavage site (between Gly22 and Ser23). Because the same band is identified by anti-His6 antibodies, which recognize the C-terminal epitope tag, the band was identified as the full length, mature NEOKINE protein.

Example 29

Binding of NEOKINE to the NEOKINE Receptor (e.g., RDC1)

T112 (NEOKINE) was radioiodinated with lactoperoxidase according to standard protocols. RDC-1 in vector Pcdna3.1 was transiently transfected into 293 cells using calcium phosphate precipitation methodology. 72 hours after transfection, cells were harvested and binding assays performed under standard binding conditions for chemokines (e.g., low salt binding, high salt wash, binding at 24° C., 1 hour). Cells were then pelleted, washed, and radioactivity was counted. Binding was demonstrated and was determined to be high affinity by competition with unlabelled T112. The cpm bound in cell pellets in indicated below.

| $^{125}$I-T112 | 0.1 nm | 37613.0 cpm | 27014.0 cpm |
| T112 | 3.0 nm | 8343.0 cpm | 9229.0 cpm |

Example 30

Isolation and Characterization of Human T129 cDNAs

Human mesangial cells (Clonetics Corporation; San Diego, Calif.) were expanded in culture with Mesangial Cell Growth Media (Clonetics) according to the recommendations of the supplier. When the cells reached 80-90% confluence, they were stimulated with tumor necrosis factor (TNF; 10 ng/ml) and cycloheximide (CHI; 40 micrograms/ml) for 4 hours. Total RNA was isolated using the RNeasy Midi Kit (Qiagen; Chatsworth, Calif.), and the poly A+ fraction was further purified using Oligotex beads (Qiagen).

Three micrograms of poly A+ RNA were used to synthesize a cDNA library using the Superscript cDNA Synthesis kit (Gibco BRL; Gaithersburg, Md.). Complementary DNA was directionally cloned into the expression plasmid pMET7 using the SalI and NotI sites in the polylinker to construct a plasmid library. Transformants were picked and grown up for single-pass sequencing.

One clone, jthKb042d12, showed limited homology to OX40 (Latza et al. (1994) *Eur. J. Immunol.* 24:677), a member of the TNF receptor superfamily, and was sequenced further. Complete sequencing of the clone revealed an approximately 2.5 kb cDNA insert with a 1290 base pair open reading frame predicted to encode a novel 430 amino transmembrane protein.

Example 31

Distribution of T129 mRNA in Human Tissues

The expression of T129 was analyzed using Northern blot hybridization. A 567 bp portion of T129 cDNA encoding the amino terminus of T129 protein was generated by PCR. The DNA was radioactively labeled with $^{32}$P-dCTP using the Prime-It kit (Stratagene; La Jolla, Calif.) according to the instructions of the supplier. Filters containing human mRNA (MTNI and MTNII: Clontech; Palo Alto, Calif.) were probed in ExpressHyb hybridization solution (Clontech) and washed at high stringency according to manufacturer's recommendations.

These studies revealed that T129 is expressed as an approximately 3.0 kilobase transcript at moderate levels in peripheral blood leukocytes, spleen, and skeletal muscle. Lower levels of transcript were seen in heart, brain and placenta. In addition, a hybridization signal was seen in peripheral blood leukocytes at >15 kb.

Example 32

Characterization of T129 Proteins

In this example, the predicted amino acid sequence of human T129 protein was compared to amino acid sequences of known proteins and various motifs were identified. In addition, the molecular weight of the human T129 proteins was predicted.

The human T129 cDNA isolated as described above (SEQ ID NO:137) encodes a 430 amino acid protein (SEQ ID NO:138). The signal peptide prediction program SIGNALP Optimized Tool (Nielsen et al. (1997) *Protein Engineering* 10:1-6) predicted that T129 includes a 22 amino acid signal peptide (amino acid 1 to about amino acid 22 of SEQ ID NO:137) preceding the 408 mature protein (about amino acid 23 to amino acid 430; SEQ ID NO:140). T129 also include one predicted transmembrane domain (amino acids 163-186 of SEQ ID NO:138). A hydropathy plot of T129 is presented in FIG. 6. This plot shows the two predicted TM domains as well as a extracellular region (labelled "OUT"; amino acids 31 to 162 of SEQ ID NO:138) and a cytoplasmic region (labelled "IN"; amino acids 187 to 430 of SEQ ID NO:138) as well as the location of cysteines ("cys"; short vertical lines just below plot) and the TNFR/NGFR cysteine-rich domain indicated by its PFAM identifier (PF0020; bar just above plot). For general information regarding PFAM identifiers refer to Sonnhammer et al. (1997) *Protein* 28:405-420.

T129 has a region (amino acids 51-90; SEQ ID NO:142) of homology to a TNFR/NGFR cysteine-rich domain consensus derived from a hidden Markov model (SEQ ID NO:141). The TNFR/NGFR cysteine-rich domain of T129 does not include all the conserved cysteines usually present in such domains (4 of 6). Moreover, unlike other members of the TNF superfamily, T129 includes only one such domain; most TNF family members include two to four such cysteine rich domains.

Mature T129 has a predicted MW of 43.5 kDa (46 kDa for immature T129), not including post-translational modifications.

Example 33

Preparation of T129 Proteins

Recombinant T129 can be produced in a variety of expression systems. For example, the mature T129 peptide can be expressed as a recombinant glutathione-S-transferase (GST) fusion protein in *E. coli* and the fusion protein can be isolated and characterized. Specifically, as described above, T129 can be fused to GST and this fusion protein can be expressed in *E. coli* strain PEB199. Expression of the GST-T129 fusion protein in PEB199 can be induced with IPTG. The recombinant fusion protein can be purified from crude bacterial lysates of the induced PEB 199 strain by affinity chromatography on glutathione beads.

Deposit of Microorganisms

A nucleic acid encoding a full-length human Delta protein is contained in a plasmid which was deposited with the American Type Culture Collection, 10801 University Boulevard, Manassas, Va. 20110-2209 (ATCC®) on Mar. 5, 1997 and has been assigned ATCC® accession number 98348.

A clone containing the cDNA molecule encoding human A259, (clone Human 12) was deposited with the American Type Culture Collection, 10801 University Boulevard, Manassas, Va., 20110-2209, on Apr. 2, 1999 as Accession Number 207190, as a single deposit.

A clone containing the cDNA molecule encoding mouse A259, (clone Mouse 12) was deposited with the American Type Culture Collection, 10801 University Boulevard, Manassas, Va., 20110-2209, on Apr. 2, 1999 as Accession Number 207191, as a single deposit.

EQUIVALENTS

Those skilled in the art will recognize, or be able to ascertain using no more than routine experimentation, many equivalents of the specific embodiments of the invention described herein. Such equivalents are intended to be encompassed by the following claims.

All publications, patents and patent applications mentioned in this specification are herein incorporated by reference into the specification to the same extent as if each individual publication, patent or patent application was specifically and individually indicated to be incorporated herein by reference.

---

SEQUENCE LISTING (195 sequences)

SEQ ID NO: 1 - DNA, 2800 bp, Homo Sapiens
  CDS (338)...(2395)
gtcgacccacgcgtccggctgcgcgcaggccgggaacacgaggccaagagccgcagccccagccgccttggtgcagcgtacaccggcactagcccgcttgcagccccaggattagacagaagacgcgtcctcggcgcggtcgccgcccagccgtagtcacctggattacctacagcggcagctgcagcggagccagcgagaaggccaaaggggagcagcgtcccgagaggagcgcctcttttcagggaccccgccggctggcggacgcgcgggaaagcggcgtcgcgaacagagccagattgagggcccgcgggtggagagagcgacgcccgaggggatggcggcagcgtcccggagcgcctctggctgggcgctactgctgctggtggcactttggcagcagcgcgcggccggctccggcgtcttccagctgcagctgcaggagttcatcaacgagcgcggcgtactggccagtgggcggccttgcgagcccggctgccggactttcttccgcgtctgccttaagcacttccaggcggtcgtctcgcccggaccctgcaccttcgggaccgtctccacgccggtattgggcaccaactccttcgctgtccgggacgacagtagcggcggggggcgcaaccctctccaactgcccttcaatttcacctggccgggtaccttctcgctcatcatcgaagcttggcacgcgccaggagacgacctgcggccagaggccttgccaccagatgcactcatcagcaagatcgccatccagggctccctagctgtgggtcagaactggttattggatgagcaaaccagcaccctcacaaggctgcgctactcttaccgggtcatctgcagtgacaactactatggagacaactgctcccgcctgtgcaagaagcgcaatgaccacttcggccactatgtgtgccagccagatggcaacttgtcctgcctgcccggttggactggggaatattgccaacagcctatctgtctttcgggctgtcatgaacagaatggctactgcagcaagccagcagagtgcctctgccgcccaggctggcagggccggctgtgtaacgaatgcatcccccacaatggctgtcgccacggcacctgcagcactccctggcaatgtacttgtgatgagggctggggaggcctgttttgtgaccaagatctcaactactgcacccaccactccccatgcaagaatggggcaacgtgctccaacagtgggcagcgaagctacacctgcacctgtcgcccaggctacactggtgtggactgtgagctggagctcagcgagtgtgacagcaacccctgtcgcaatggaggcagctgtaaggaccaggaggatggctaccactgcctgtgtcctccgggctactatggcctgcattgtgaacacagcaccttgagctgcgccgactccccctgcttcaatgggggctcctgccgggagcgcaaccagggggccaactatgcttgtgaatgtccccccaacttcaccggctccaactgcgagaagaaagtggacaggtgcaccagcaacccctgtgccaacgggggacagtgcctgaaccgaggtccaagccgcatgtgccgctgccgtcctggattcacgggcacctactgtgaactccacgtcagcgactgtgcccgtaacccttgcgcccacggtggcacttgccatgacctggagaatgggctcatgtgcacctgccctgccggcttctctggccgacgctgtgaggtgcggacatccatcgatgcctgtgcctcgagtccctgcttcaacagggccacctgctacaccgacctctccacagacacctttgtgtgcaactgcccttatggctttgtgggcagccgctgcgagttccccgtgggcttgccgcccagcttcccctgggtggccgtctcgctgggtgtggggctggcagtgctgctggtactgctgggcatggtggcagtggctgtgcggcagctgcggcttcgacggccggacgacggcagcagggaagccatgaacaacttgtcggacttccagaaggacaacctgattcctgccgcccagcttaaaaacacaaaccagaagaaggagctggaagtggactgtggcctggacaagtccaactgtggcaaacagcaaaaccacacattggactataatctggccccagggcccctggggcgggggaccatgccaggaaagtttccccacagtgacaagagcttaggagagaaggcgccactgcggttacacagtgaaaagccagagtgtcggatatcagcgatgtgctcccccagggactccatgtaccagtctgtgtgtttgatatcagaggagaggaatgaatgtgtcattgccacggaggtataaggcaggagcctacctggacatccctgctcagccccgcggctggaccttccttctgcattgtttacattgcatcctggatgggacgtttttcatatgcaacgtgctgctctcaggaggaggagggaatggcaggaaccggacagactgtgaacttgccaagagatgcaatacccttccacacctttgggtgtctgtctggcatcagattggcagctgcaccaaccagaggaacagaagagaagagagtggcagtagccccatggggcccggagctgctgtggcctccactggcatccgtgtttccaaaagtgcctttggcccagccaagggtgccaggcctaactggggcactcagggcagtgtgttggaaattccactgagggggaaatcaggtgctgcggccgc

SEQ ID NO: 2 - protein, 685 aa, Homo Sapiens
MAAASRSASGWALLLLVALWQQRAAGSGVFQLQLQEFINERGVLASGRPCEPGCRTFFRVCLKHFQAVVSPGPCTFGTVSTPVLGTNSFAVRDDSSGGGRNPLQLPFNFTWPGTFSLIIEAWHAPGDDLRPEALPPDALISKIAIQGSLAVGQNWLLDEQTSTLTRLRYSYRVICSDNYYGDNCSRLCKKRNDHFGHYVCQPDGNLSCLPGWTGEYCQQPICLSGCHEQNGYCSKPAECLCRPGWQGRLCNECIPHNGCRHGTCSTPWQCTCDEGWGGLFCDQDLNYCTHHSPCKNGATCSNSGQRSYTCTCRPGYTGVDCELELSECDSNPCRNGGSCKDQEDGYHCLCPPGYYGLHCEHSTLSCADSPCFNGGSCRERNQGANYACECPPNFTGSNCEKKVDRCTSNPCANGGQCLNRGPSRMCRCRPGFTGTYCELHVSDCARNPCAHGGTCHDLENGLMCTCPAGFSGRRCEVRTSIDACASSPCFNRATCYTDLSTDTFVCNCPYGFVGSRCEFPVGLPPSFPWVAVSLGVGLAVLLVLLGMVAVAVRQLRLRRPDDGSREAMNNLSDFQKDNLIPAAQLKNTNQKKELEVDCGLDKSNCGKQQNHTLDYNLAPGPLGRGTMPGKFPHSDKSLGEKAPLRLHSEKPECRISAMCSPRDSMYQSVCLISEERNECVIATEV

SEQ ID NO: 3 - DNA, 2055 bp, Homo Sapiens
atggcggcagcgtcccggagcgcctctggctgggcgctactgctgctggtggcactttggcagcagcgcgcggccggctccggcgtcttccagctgcagctgcaggagttcatcaacgagcgcggcgtactggccagtgggcggccttgcgagcccggctgccggactttcttccgcgtctgccttaagcacttccaggcggtcgtctcgcccggaccctgcaccttcgggaccgtctccacgccggtattgggcaccaactccttcgctgtccgggacgacagtagcggcggggggcgcaaccctctccaactgcccttcaatttcacctggccgggtaccttctcgctcatcatcgaagcttggcacgcgccaggagacgacctgcggccagaggccttgccaccagatgcactcatcagcaagatcgccatccagggctccctagctgtgggtcagaactggttattggatgagcaaaccagcaccctcacaaggctgcgctactcttaccgggtcatctgcagtgacaactactatggagacaactgctcccgcctgtgcaagaagcgcaatgaccacttcggccactatgtgtgccagccagatggcaacttgtcctgcctgcccggttggactggggaatattgccaacagcctatctgtctttcgggctgtcatgaacagaatggctactgcagcaagccagcagagtgcctctgccgcccaggctggcagggccggctgtgtaacgaatgcatcccccacaatggctgtcgccacggcacctgcagcactccctggcaatgtacttgtgatgagggctggggaggcctgttttgtgaccaagatctcaactactgcacccaccactccccatgcaagaatggggcaacgtgctccaacagtgggcagcgaagctacacctgcacctgtcgcccaggctacactggtgtggactgtgagctggagctcagcgagtgtgacagcaacccctgtcgcaatggaggcagctgtaaggaccaggaggatggctaccactgcctgtgtcctccgggctactatggcctgcattgtgaacacagcaccttgagctgcgccgactccccctgcttcaatgggggctcctgccgggagcgcaaccagggggccaactatgcttgtgaatgtccccccaacttcaccggctccaactgcgagaagaaagtggacaggtgcaccagcaacccctgtgccaacgggggacagtgcctgaaccgaggtccaagccgcatgtgccgctgccgtcctggattcacgggcacctactgtgaactccacgtcagcgactgtgcccgtaacccttgcgcccacggtggcacttgccatgacctggagaatgggctcatgtgcacctgccctgccggcttctctggccgacgctgtgaggtgcggacatccatcgatgcctgtgcctcgagtccctgcttcaacagggccacctgctacaccgacctctccacagacacctttgtgtgcaactgcccttatggctttgtgggcagccgctgcgagttccccgtgggcttgccgcccagcttcccctgggtggccgtctcgctgggtgtggggctggcagtgctgctggtactgctgggcatggtggcagtggctgtgcggcagctgcggcttcgacggccggacgacggcagcagggaagccatgaacaacttgtcggacttccagaaggacaacctgattcctgccgcccagcttaaaaacacaaaccagaagaaggagctggaagtggactgtggcctggacaagtccaactgtggcaaacagcaaaaccacacattggactataatctggccccagggcccctggggcgggggaccatgccaggaaagtttccccacagtgacaagagcttaggagagaaggcgccactgcggttacacagtgaaaagccagagtgtcggatatcagcgatgtgctcccccagggactccatgtaccagtctgtgtgtttgatatcagaggagaggaatgaatgtgtcattgccacggaggta

SEQ ID NO: 4 - protein, 720 aa, Mus Musculus
MGRRSALALAVVSALLCQVWSSGVFELKLQEFVNKKGLLGNRNCCRGGSGPPCACRTFFRVCLKHQASVSPEPPCTYGSAVTPVLGVDSFSLPDGAGIDPAFSNPIRFPFGFTWPGTFSLIIEALHTDSPDDLATENPERLISRLTTQRHTVGEEWSQDLHSSGRTDLRYSYRFVCDEHYYGEGCSVFCRPRDDAFGHFTCGDRGEKMCDPGWKGQYCTDPICLPGCDDQHGYCDKPGECKCRVGWQGRYCDECIRYPGCLHGTCQQPWQCNCQEGWGGLFCNQDLNYCTHHKPCRNGATCTNTGQGSYTCSCRPGYTGANCELEVDECAPSPCKNGASCTDLEDSFSCTCPPGFYGKVCELSAMTCADGPCFNGGRCSDNPDGGYTCHCPLGFSGFNCEKKMDLCGSSPCSNGAKCVDLGNSYLCRCQAGFSGRYCEDNVDDCASSPCANGGTCRDSVNDFSCTCPPGYTGKNCSAPVSRCEHAPCHNGATCHQRGQRYMCECAQGYGGPNCQFLLPEPPPGPMVVDLSERHMESQGGPFPWVAVCAGVVLVLLLLLGCAAVVVCVRLKLQKHQPPPEPCGGETETMNNLANCQREKDVSVSIIGATQIKNTNKKADFHGDHGAKKSSFKVRYPTVDYNLVRDLKGDEATVRDTHSKRDTKCQSQSSAGEEKIAPTLRGGEIPDRKRPESVYSTSKDTKYQSVYVLSAEKDECVIATEV

SEQ ID NO: 5 - protein, 713 aa, Rattus Norvegicus
MGRRSALALAVVSALLCQVWSSGVFELKLQEFVNKKGLLGNRNCCRGGSGPPCACRTFFRVCLKHYQASVSPEPPCTYGSAVTAVLGVDSFSLPDGAGIDPAFSNPIRFPFGFTWPGTFSLIIEALHTDSPDDLATENPERLISRLTTQRHTVGEEWSQDLHSSGRTDLRYSYRFVCDEHYYGEGCSVFCRPRDDAFGHFTCGERGEKMCDPGWKGQYCTDPICLPGCDDQHGYCDKPGECKCRVGWQGRYCDECIRYPGCLHGTCQQPWQCNCQEGWGGLFCNQDLNYCTHHKPCRNGATCTNTGQGSYTCSCRPGYTGANCELEVDECAPSPCKNGGSCTDLEDSYSCTCPPGFYGKVCELSAMTCADGPCFNGGRCSDNPDGGYTCHCPAGFSGFNCEKKIDLCSSSPCSNGAKCVDLGNSYLCRCQTGFSGRYCEDNVDDCASSPCANGGTCRDSVNDFSCTCPPGYTGKNCSAPVSRCEHAPCHNGATCHQRGQRYMCECAQGYGGANCQFLLPEPPPDLIVAAQGGSFPWVAVCAGVVLVLLLLLGCAAVVVCVRLKLQKHQPPPDPCGGETETMNNLANCQREKDVSVSIIGATQIKNTNKKADFHGDHGADKSSFKARYPTVDYNLIRDLKGDEATVRDAHSKRDTKCQSQGSAGEEKSTSTLRGGEVPDRKRPESVYSTSKDTKYQSVYVLSAEKDECVIATEV

SEQ ID NO: 6 - protein, 157 aa, Homo Sapiens
ENSYSCTCPPGFYGKICELSAMTCADGPCFNGGRCSDSPDGGYSCRCPVCYSGFNCEKKIDYCSSSPCSNGAKCVDLGDAYLCRCQAGFSCRHCDDNVDDCASSPCANGGTCRDGVNDFSCTCPPGYTGRNCSAPASRCEHAPCHNGATCHERGHRY

SEQ ID NO: 7 - protein, 721 aa, Xenopus Laevis
MGQQRMLTLLVLSAVLCQISCSGLFELRLQEFVNKKGLLGNMNCCRPGSLASLQRCECKTFFRICLKHYQSNVSPEPPCTYGGAVTPVLGTNSFVVPESSNADPTFSNPIRFPFGFTWPGTFSLIIEAIHADSADDLNTENPERLISRLATQRHLTVGEQWSQDLHSSDRTELKYSYRFVCDEYYYGEGCSDYCRPRDDAFGHFSCGEKGENLCNPGWKGLYCTEPICLPGCDEHHGYCDKPGECKCRVGWQGRYCDECIRYPGCLHGTCQQPWQCNCQEGWGGLFCNQDLNYCTHHKPCENGATCTNTGQGSYTCSCRPGYTGSNCEIEVNECDANPCKNGGSCSDLENSYTCSCPPGFYGKNCELSAMTCADGPCFNGGRCADNPDGGYICPCPVGYSGFNCEKKIDYCSSNPCANGARCEDLGNSYICQCQEGFSGRNCDDNLDDCTSFPCQNGGTCQDGINDYSCTCPPGYIGKNCSMPITKCEHNPCHNGATCHERNNRYVCQCARGYGGNNCQFLLPEEKPVVVDLTEKYTEGQSGQFPWIAVCAGIVLVLMLLLGCAAVVVCVRVRVQKRRHQPEACRGESKTMNNLANCQREKDISVSFIGTTQIKNTNKKIDFLSESNNEKNGYKPRYPSVDYNLVHELKNEDSPKEERSKCEAKCSSNDSDSEDVNSVHSKRDSSERRRPDSAYSTSKDTKYQSVYVISDEKDECIIATEV

SEQ ID NO: 8 - protein, 729 aa, Gallus Gallus
MGGRFLLTLALLSALLCRCQVDGSGVFELKLQEFVNKKGLLSNRNCCRGGGPGGAGQQQCDCKTFFRVCLKHYQASVSPEPPCTYGSAITPVLGANSFSVPDGAGGADPAFSNPIRFPFGFTWPGTFSLIIEALHTDSPDDLTTENPERLISRLATQRHLAVGEEWSQDLHSSGRTDLKYSYRFVCDEHYYGEGCSVFCRPRDDRFGHFTCGERGEKVCNPGWKGQYCTEPICLPGCDEQHGFCDKPGECKCRVGWQGRYCDECIRYPGCLHGTCQQPWQCNCQEGWGGLFCNQDLNYCTHHKPCKNGATCTNTGQGSYTCSCRPGYTGSSCEIEINECDANPCKNGGSCTDLENSYSCTCPPGFYGKNCELSAMTCADGPCFNGGRCTDNPDGGYSCRCPLGYSGFNCEKKIDYCSSSPCANGAQACVDLGNSYICQCQAGFTGRHCDDNVDDCASFPCVNGGTCQDGVNDYSCTCPPGYNGKNCSTPVSRCEHNPCHNGATCHERSNRYVCECARGYGGLNCQFLLPEPPQGPVIVDFTEKYTEGQNSQFPWIAVCAGIILVLMLLLGCAAIVVCVRLKVQKRHHQPEACRSETETMNNLANCQREKDISISVIGATQIKNTNKKVDFHSDNSDKNGYKVRYPSVDYNLVHELKNEDSVKEEHGKCEAKCETYDSEAEEKSAVQLKSSDTSERKRPDSVYSTSKDTKYQSVYVISEEKDECIIATEV

SEQ ID NO: 9 - protein, 717 aa, Danio Rerio
MGRLMIAVLLCVMISQGFCSGVFELKLQEFLNKKGVTGNANCCKGSAAEGHQCECKTFFRICLKHYQANVSPDPPCTYGGAVTPVLGSNSFQVPESFPDSSFTNPIPFAFGFTWPGTFSLIIEALHTDSTDDLSTENPDRLISRMTTQRHLTVGEEWSQDLQVGGRTELKYSYRFVCDEHYYGEGCSVFCRPRDDTFGHFTCGERGEIICNSGWKGQYCTEPICLPGCDEDHGFCDKPGECKCRVGFSGKYCDDCIRYPGCLHGTCQQPWQCNCQEGWGGLFCNQDLNYCTHHKPCQNGATCTNTGQGSYTCSCRPGFTGDSCEIEVNECSGSPCRNGGSCTDLENTYSCTCPPGFYGRNCELSAMTCADGPCFNGGHCADNPEGGYFCQCPMGYAGFNCEKKIDHCSSNPCSNDAQCLDLVDSYLCQCPEGFTGTHCEDNIDECATYPCQNGGTCQDGLSDYTCTCPPGYTGKNCTSAVNKCLHNPCHNGATCHEMDNRYVCACIPGYGGRNCQFLLPENPQGQAIVEGADKRYSYEEDDGGFPWTAVCAGIILVLLVLIGGSVFVIYIRLKLQQRSQQIDSHSEIETMNNLTNNRSREKDLSVSIIGATQVKNINKKVDFQSDGDKNGFKSRYSLVDYNLVHELKQEDLGKEDSERSEATKCEPLDSDSEEKHRNHLKSDSSERKRTESLCKDTKYQSVFVLSEEKDECIIATEV

SEQ ID NO: 10 - protein, 642 aa, Xenopus Laevis
MASPLLLVYVAATLCLPLVYPAGVFELKIHSFSTPRPACAAGKSCNIFFRVCLKHAQPVVSPDPPCTFGSAVSDILPSDSKAITDSSPIRVPFHFKWPGIFSLIIESWTTNSAEQSTENPDNLLSRLATRRRLSIGEDWSQDIHLGQQSELRYSYHVSCDEHYYGDSCSDYCRPRDDNFGHYTCDEQGNRLCMSGWKGEYCAEPICLPGCSESHGFCELPGECKCRMGWQGELCDECLRYPGCQHGSCSQPWECICQEGWGGLFCNQDLNYCTNHQPCRNGASCINIGQGSYSCSCRAGFTGTNCEIDINECASNPCKNGGSCNDLENDYECVCPRGFYGKNCDISAMTCEDGPCFNGGTCIEKSSGVGYVCRCPPNYHGSNCEKKIDRCTNSPCLNGGQCLDMGRNVLCKCRPGPSGPRCELNIDDCASSPCANGGTCVDAVNSYTCSCTLGYGGKDCTLRVDACSSKPCKNGGTCYTKFTGNVCQCPTGFMGTSCEFRVHDPTPASHRADSSNTLTMVVCLGLLTFFLLGCGVFMVMRGMRRGHFNEKGRVNNDLEPKNNLIEKEPHFKMPNPDYLREKSSSKQKLLQGSESEEERSGRRTDRKPDTKQCNPTSRYPEDGAYHPIYILPEPEQCIFATEV

SEQ ID NO: 11 - protein, 830 aa, Drosophila Melanogaster
MHWIKCLLTAFICFTVIVQVHSSGSFELRLKYFSNDHGRDNEGRCCSGESDGATGKCLGSCKTRFRVCLKHYQATIDTTSQCTYGDVITPILGENSVNLTDAQRFQNKGFTNPIQFPFSFSWPGTFSLIVEAWHDTNNSGNARTNKLLIQRLLVQQVLEVSSEWKTNKSESQYTSLEYDFRVTCDLNYYGSGCAKFCRPRDDSFGHSTCSETGEIICLTGWQGDYCHIPKCAKGCEHGHCDKPNQCVCQLGWKGALCNECVLEPNCIHGTCNKPWTCICNEGWGGLYCNQDLNYCTNHRPCKNGGTCFNTGEGLYTCKCAPGYSGDDENEIYSCDADVNPCQNGGTCIDEPHTKTGKCHCANGWSGKMCEEKVLTCSDKPCHQGICRNVRPGLGSKGQGYQCECPIGYSGPNCDLQLDNCSPNPCINGGSCQPSGKCICPAGFSGTRCETNIDDCLGHQCENGGTCIDMVNQYRCQCVPGFHGTHCSSKVDLCLIRPCANGGTCLNLNNDYQCTCRAGFTGKDCSVDIDECSSGPCHNGGTCMNRVNSFECVCANGFRGKQCDEESYDSVTFDAHQYGATTQARADGLTNAQVVLIAVFSVAMPLVAVIAACVVFCMKRKRKRAQEKDDAEARKQNEQNAVATMHHNGSGVGVALASASLGGKTGSNSGLTFDGGNPNIIKNTWDKSVNNICASAAAAAAAAAAADECLMYGGYVASVADNNNANSDFCVAPLQRAKSQKQLNTDPTLMHRGSPAGSSAKGASGGGPGAAEGKRISVLGEGSYCSQRWPSLAAAGVAGACSSQLMAAASAAGTDGTAQQQRSVVCGTPHM

SEQ ID NO: 12 - DNA, 20 bp, Homo Sapiens
agcgcctctggctgggcgct

SEQ ID NO: 13 - DNA, 20 bp, Homo Sapiens
cggccagaggccttgccacc

SEQ ID NO: 14 - DNA, 20 bp, Homo Sapiens
ttgcgctcccggctggagcc

SEQ ID NO: 15 - DNA, 20 bp, Homo Sapiens
atgcggcttggacctcggtt

SEQ ID NO: 16 - DNA, 21 bp, Homo Sapiens
tgccgccatccctcggggcgt

SEQ ID NO: 17 - DNA, 20 bp, Homo Sapiens
ggacgctgccgccatcccct

SEQ ID NO: 18 - DNA, 28 bp, Homo Sapiens
ggacgctgccgccatcccctcggggcgt

SEQ ID NO: 19 - DNA, 20 bp, Homo Sapiens
tcaatctggctctgttcgcg

SEQ ID NO: 20 - DNA, 26 bp, Homo Sapiens
cgctctctccacccgcgggccctcaa

SEQ ID NO: 21 - DNA, 171 bp, Homo Sapiens
  misc_feature (1)...(171): n = A,T,C or G
gcccaggcngaccctggtgtggactgtgagctggagctcagcgagtgtgacagcaacccctgtcgcantggaggcagctgtaaggaccangaggatggctaccactgcctgtgtcctccgggctactacggcntgcatcgtgaacacngcacctcttagctgngccgactc

SEQ ID NO: 22 - DNA, 20 bp, Homo Sapiens
ctcttctgttcctctggttg

SEQ ID NO: 23 - protein, 45 aa, Artificial Sequence
  DSL domain consensus sequence
  VARIANT (1)...(2): Xaa = any amino acid
  VARIANT (4)...(6): Xaa = any amino acid
  VARIANT (8)...(8): Xaa = Phe or Tyr
  VARIANT (10)...(11): Xaa = any amino acid
  VARIANT (13)...(15): Xaa = any amino acid
  VARIANT (17)...(17): Xaa = His or Arg
  VARIANT (18)...(18): Xaa = any amino acid
  VARIANT (20)...(20): Xaa = any amino acid
  VARIANT (22)...(22): Xaa = any amino acid
  VARIANT (25)...(25): Xaa = His or Arg
  VARIANT (26)...(27): Xaa = any amino acid
  VARIANT (29)...(31): Xaa = any amino acid
  VARIANT (33)...(35): Xaa = any amino acid
  VARIANT (37)...(38): Xaa = any amino acid
  VARIANT (41)...(41): Xaa = any amino acid
  VARIANT (43)...(43): Xaa = any amino acid
XXCXXXYXGXXCXXXCXXRXDXFGXXXCXXXGXXXCXXGWXGXYC

SEQ ID NO: 24 - DNA, 3133 bp, Mus Musculus
  CDS (39)...(2099)
gtcgacccacgcgtccggtggagaggacaccccaagggatgacgcctgcgtcccggagcgcctgtcgctgggcgctactgctgctggcggtactgtggccgcagcagcgcgctgcgggctccggcatcttccagctgcggctgcaggagttcgtcaaccagcgcggtatgctggccaatgggcagtcctgcgaaccgggctgccggactttcttccgcatctgccttaagcacttccaggcaaccttctccgagggaccctgcacctttggcaatgtctccacgccggtattgggcaccaactccttcgtcgtcagggacaagaatagcggcagtggtcgcaaccctctgcagttgcccttcaatttcacctggccgggaaccttctcactcaacatccaagcttggcacacaccgggagacgacctgcggccagagacttcgccaggaaactctctcatcagccaaatcatcatccaaggctctcttgctgtgggtaagatttggcgaacagacgagcaaaatgacaccctcaccagactgagctactcttaccgggtcatctgcagtgacaactactatggagagagctgttctcgcctatgcaagaagcgcgatgaccacttcggacattatgagtgccagccagatggcagcctgtcctgcctgccgggctggactgggaagtactgtgaccagcctatatgtctttctggctgtcatgagcagaatggttactgcagcaagccagatgagtgcatctgccgtccaggttggcagggtcgcctgtgcaatgaatgtatcccccacaatggctgtcgtcatggcacctgcagcatcccctggcagtgtgcctgcgatgagggatggggaggtctgttttgtgaccaagatctcaactactgtactcaccactctccgtgcaagaatggatcaacgtgttccaacagtgggccaaagggttatacctgcacctgtctcccaggctacactggtgagcactgtgagctgggactcagcaagtgtgccagcaacccctgtcgaaatggtggcagctgtaaggaccaggagaatagctaccactgcctgtgtcccccaggctactatggccagcactgtgagcatagtaccttgacctgcgcggactcaccctgcttcaatgggggctcttgccgggagcgcaaccaggggtccagttatgcctgcgaatgcccccccaactttaccggctctaactgtgagaagaaagtagacaggtgtaccagcaacccgtgtgccaatggaggccagtgccagaacagaggtccaagccgaacctgccgctgccggcctggattcacaggcacccactgtgaactgcacatcagcgattgtgcccgaagtccctgtgcccacgggggcacttgccacgatctggagaatgggcctgtgtgcacctgccccgctggcttctctggaaggcgctgcgaggtgcggataacccacgatgcctgtgcctccggaccctgcttcaatggggccacctgctacactggcctctccccaaacaacttcgtctgcaactgtccttatggctttgtgggcagccgctgcgagtttcccgtgggcttgccacccagcttcccctgggtagctgtctcgctgggcgtggggctagtggtactgctggtgctcctggtcatggtggtagtggctgtgcggcagctgcggcttcggaggcccgatgacgagagcagggaagccatgaacaatctgtcagacttccagaaggacaacctaatccctgccgcccagctcaaaaacacaaaccagaagaaggagctggaagtggactgtggtctggacaagtccaattgtggcaaactgcagaaccacacattggactacaatctagccccgggactcctaggacggggcggcatgcctgggaagtatcctcacagtgacaagagcttaggagagaaggtgccacttcggttacacagtgagaagccagagtgtcgaatatcagccatttgctctcccagggactctatgtaccaatcagtgtgtttgatatcagaagagaggaacgagtgtgtgattgccacagaggtataaggcaggagcctactcagacacccagctccggcccagcagctgggccttccttctgcattgtttacattgcatcctgtatgggacatctttagtatgcacagtgctgctctgcggaggaggaggaaatggcatgaactgaacagactgtgaacccgccaagagtcgcaccggctctgcacacctccaggagtctgcctggcttcagatgggcagccccgccaagggaacagagttgaggagttagaggagcatcagttgagctgatatctaaggtgcctctcgaacttggacttgctctgccaacagtggtcatcatggagctcttgactgttctccagagagtggcagtggccctagtgggtcttggcgctgctgtagctcctgtgggcatctgtatttccaaagtgcctttgcccagactccatcctcacagctgggcccaaatgagaaagcagagaggaggcttgcaaaggataggcctcccgcaggcagaacagccttggagtttggcattaagcaggagctactctgcaggtgaggaaagcccgaggaggggacacgtgtgactcctgcctccaaccccagtaggtggagtgccacctgtagcctctaggcaagagttggtccttcccctggtcctggtgcctctgggctcatgtgaacagatgggcttagggcacgccccttttgccagccaggggtacaggcctcactggggagctcagggccttcatgctaaactcccaataagggagatggggggaagggggctgtggcctaggcccttccctccctcacacccatttctgggcccttgagcctgggctccaccagtgcccactgctgccccgagaccaaccttgaagccgatcttcaaaaatcaataatatgaggttttgttttgtagtttattttggaatctagtattttgataatttaagaatcagaagcactggcctttctacattttataacattattttgtatataatgtgtatttataatatgaaaaaaaaaaaaaaaagggcggccgc

SEQ ID NO: 25 - protein, 686 aa, Mus Musculus
MTPASRSACRWALLLLAVLWPQQRAAGSGIFQLRLQEFVNQRGMLANGQSCEPGCRTFFRICLKHFQATFSEGPCTFGNVSTPVLGTNSFVVRDKNSGSGRNPLQLPFNFTWPGTFSLNIQAWHTPGDDLRPETSPGNSLISQIIIQGSLAVGKIWRTDEQNDTLTRLSYSYRVICSDNYYGESCSRLCKKRDDHFGHYECQPDGSLSCLPGWTGKYCDQPICLSGCHEQNGYCSKPDECICRPGWQGRLCNECIPHNGCRHGTCSIPWQCACDEGWGGLFCDQDLNYCTHHSPCKNGSTCSNSGPKGYTCTCLPGYTGEHCELGLSKCASNPCRNGGSCKDQENSYHCLCPPGYYGQHCEHSTLTCADSPCFNGGSCRERNQGSSYACECPPNFTGSNCEKKVDRCTSNPCANGGQCQNRGPSRTCRCRPGFTGTHCELHISDCARSPCAHGGTCHDLENGPVCTCPAGFSGRRCEVRITHDACASGPCFNGATCYTGLSPNNFVCNCPYGFVGSRCEFPVGLPPSFPWVAVSLGVGLVVLLVLLVMVVVAVRQLRLRRPDDESREAMNNLSDFQKDNLIPAAQLKNTNQKKELEVDCGLDKSNCGKLQNHTLDYNLAPGLLGRGGMPGKYPHSDKSLGEKVPLRLHSEKPECRISAICSPRDSMYQSVCLISEERNECVIATEV

SEQ ID NO: 26 - DNA, 2058 bp, Mus Musculus
atgacgcctgcgtcccggagcgcctgtcgctgggcgctactgctgctggcggtactgtggccgcagcagcgcgctgcgggctccggcatcttccagctgcggctgcaggagttcgtcaaccagcgcggtatgctggccaatgggcagtcctgcgaaccgggctgccggactttcttccgcatctgccttaagcacttccaggcaaccttctccgagggaccctgcacctttggcaatgtctccacgccggtattgggcaccaactccttcgtcgtcagggacaagaatagcggcagtggtcgcaaccctctgcagttgcccttcaatttcacctggccgggaaccttctcactcaacatccaagcttggcacacaccgggagacgacctgcggccagagacttcgccaggaaactctctcatcagccaaatcatcatccaaggctctcttgctgtgggtaagatttggcgaacagacgagcaaaatgacaccctcaccagactgagctactcttaccgggtcatctgcagtgacaactactatggagagagctgttctcgcctatgcaagaagcgcgatgaccacttcggacattatgagtgccagccagatggcagcctgtcctgcctgccgggctggactgggaagtactgtgaccagcctatatgtctttctggctgtcatgagcagaatggttactgcagcaagccagatgagtgcatctgccgtccaggttggcagggtcgcctgtgcaatgaatgtatcccccacaatggctgtcgtcatggcacctgcagcatcccctggcagtgtgcctgcgatgagggatggggaggtctgttttgtgaccaagatctcaactactgtactcaccactctccgtgcaagaatggatcaacgtgttccaacagtgggccaaagggttatacctgcacctgtctcccaggctacactggtgagcactgtgagctgggactcagcaagtgtgccagcaacccctgtcgaaatggtggcagctgtaaggaccaggagaatagctaccactgcctgtgtcccccaggctactatggccagcactgtgagcatagtaccttgacctgcgcggactcaccctgcttcaatgggggctcttgccgggagcgcaaccaggggtccagttatgcctgcgaatgcccccccaactttaccggctctaactgtgagaagaaagtagacaggtgtaccagcaacccgtgtgccaatggaggccagtgccagaacagaggtccaagccgaacctgccgctgccggcctggattcacaggcacccactgtgaactgcacatcagcgattgtgcccgaagtccctgtgcccacgggggcacttgccacgatctggagaatgggcctgtgtgcacctgccccgctggcttctctggaaggcgctgcgaggtgcggataacccacgatgcctgtgcctccggaccctgcttcaatggggccacctgctacactggcctctccccaaacaacttcgtctgcaactgtccttatggctttgtgggcagccgctgcgagtttcccgtgggcttgccacccagcttcccctgggtagctgtctcgctgggcgtggggctagtggtactgctggtgctcctggtcatggtggtagtggctgtgcggcagctgcggcttcggaggcccgatgacgagagcagggaagccatgaacaatctgtcagacttccagaaggacaacctaatccctgccgcccagctcaaaaacacaaaccagaagaaggagctggaagtggactgtggtctggacaagtccaattgtggcaaactgcagaaccacacattggactacaatctagccccgggactcctaggacggggcggcatgcctgggaagtatcctcacagtgacaagagcttaggagagaaggtgccacttcggttacacagtgagaagccagagtgtcgaatatcagccatttgctctcccagggactctatgtaccaatcagtgtgtttgatatcagaagagaggaacgagtgtgtgattgccacagaggta

SEQ ID NO: 27 - DNA, 2800 bp, Homo Sapiens
  CDS (338)...(2395)
gtcgacccacgcgtccggctgcgcgcaggccgggaacacgaggccaagagccgcagccccagccgccttggtgcagcgtacaccggcactagcccgcttgcagccccaggattagacagaagacgcgtcctcggcgcggtcgccgcccagccgtagtcacctggattacctacagcggcagctgcagcggagccagcgagaaggccaaaggggagcagcgtcccgagaggagcgcctcttttcagggaccccgccggctggcggacgcgcgggaaagcggcgtcgcgaacagagccagattgagggcccgcgggtggagagagcgacgcccgaggggatggcggcagcgtcccggagcgcctctggctgggcgctactgctgctggtggcactttggcagcagcgcgcggccggctccggcgtcttccagctgcagctgcaggagttcatcaaccagcgcggcgtactggccagtgggcggccttgcgagcccggctgccggactttcttccgcgtctgccttaagcacttccaggcggtcgtctcgcccggaccctgcaccttcgggaccgtctccacgccggtattgggcaccaactccttcgctgtccgggacgacagtagcggcggggggcgcaaccctctccaactgcccttcaatttcacctggccgggtaccttctcgctcatcatcgaagcttggcacgcgccaggagacgacctgcggccagaggccttgccaccagatgcactcatcagcaagatcgccatccagggctccctagctgtgggtcagaactggttattggatgagcaaaccagcaccctcacaaggctgcgctactcttaccgggtcatctgcagtgacaactactatggagacaactgctcccgcctgtgcaagaagcgcaatgaccacttcggccactatgtgtgccagccagatggcaacttgtcctgcctgcccggttggactggggaatattgccaacagcctatctgtctttcgggctgtcatgaacagaatggctactgcagcaagccagcagagtgcctctgccgcccaggctggcagggccggctgtgtaacgaatgcatcccccacaatggctgtcgccacggcacctgcagcactccctggcaatgtacttgtgatgagggctggggaggcctgttttgtgaccaagatctcaactactgcacccaccactccccatgcaagaatggggcaacgtgctccaacagtgggcagcgaagctacacctgcacctgtcgcccaggctacactggtgtggactgtgagctggagctcagcgagtgtgacagcaacccctgtcgcaatggaggcagctgtaaggaccaggaggatggctaccactgcctgtgtcctccgggctactatggcctgcattgtgaacacagcaccttgagctgcgccgactccccctgcttcaatgggggctcctgccgggagcgcaaccagggggccaactatgcttgtgaatgtccccccaacttcaccggctccaactgcgagaagaaagtggacaggtgcaccagcaacccctgtgccaacgggggacagtgcctgaaccgaggtccaagccgcatgtgccgctgccgtcctggattcacgggcacctactgtgaactccacgtcagcgactgtgcccgtaacccttgcgcccacggtggcacttgccatgacctggagaatgggctcatgtgcacctgccctgccggcttctctggccgacgctgtgaggtgcggacatccatcgatgcctgtgcctcgagtccctgcttcaacagggccacctgctacaccgacctctccacagacacctttgtgtgcaactgcccttatggctttgtgggcagccgctgcgagttccccgtgggcttgccgcccagcttcccctgggtggccgtctcgctgggtgtggggctggcagtgctgctggtactgctgggcatggtggcagtggctgtgcggcagctgcggcttcgacggccggacgacggcagcagggaagccatgaacaacttgtcggacttccagaaggacaacctgattcctgccgcccagcttaaaaacacaaaccagaagaaggagctggaagtggactgtggcctggacaagtccaactgtggcaaacagcaaaaccacacattggactataatctggccccagggcccctggggcgggggaccatgccaggaaagtttccccacagtgacaagagcttaggagagaaggcgccactgcggttacacagtgaaaagccagagtgtcggatatcagcgatgtgctcccccagggactccatgtaccagtctgtgtgtttgatatcagaggagaggaatgaatgtgtcattgccacggaggtataaggcaggagcctacctggacatccctgctcagccccgcggctggaccttccttctgcattgtttacattgcatcctggatgggacgtttttcatatgcaacgtgctgctctcaggaggaggagggaatggcaggaaccggacagactgtgaacttgccaagagatgcaatacccttccacacctttgggtgtctgtctggcatcagattggcagctgcaccaaccagaggaacagaagagaagagagtggcagtagccccatggggcccggagctgctgtggcctccactggcatccgtgtttccaaaagtgcctttggcccagccaagggtgccaggcctaactggggcactcagggcagtgtgttggaaattccactgagggggaaatcaggtgctgcggccgc

SEQ ID NO: 28 - protein, 685 aa, Homo Sapiens
MAAASRSASGWALLLLVALWQQRAAGSGVFQLQLQEFINQRGVLASGRPCEPGCRTFFRVCLKHFQAVVSPGPCTFGTVSTPVLGTNSFAVRDDSSGGGRNPLQLPFNFTWPGTFSLIIEAWHAPGDDLRPEALPPDALISKIAIQGSLAVGQNWLLDEQTSTLTRLRYSYRVICSDNYYGDNCSRLCKKRNDHFGHYVCQPDGNLSCLPGWTGEYCQQPICLSGCHEQNGYCSKPAECLCRPGWQGRLCNECIPHNGCRHGTCSTPWQCTCDEGWGGLFCDQDLNYCTHHSPCKNGATCSNSGQRSYTCTCRPGYTGVDCELELSECDSNPCRNGGSCKDQEDGYHCLCPPGYYGLHCEHSTLSCADSPCFNGGSCRERNQGANYACECPPNFTGSNCEKKVDRCTSNPCANGGQCLNRGPSRMCRCRPGFTGTYCELHVSDCARNPCAHGGTCHDLENGLMCTCPAGFSGRRCEVRTSIDACASSPCFNRATCYTDLSTDTFVCNCPYGFVGSRCEFPVGLPPSFPWVAVSLGVGLAVLLVLLGMVAVAVRQLRLRRPDDGSREAMNNLSDFQKDNLIPAAQLKNTNQKKELEVDCGLDKSNCGKQQNHTLDYNLAPGPLGRGTMPGKFPHSDKSLGEKAPLRLHSEKPECRISAMCSPRDSMYQSVCLISEERNECVIATEV

SEQ ID NO: 29 - DNA, 2800 bp, Homo Sapiens
  CDS (338)...(457)
gtcgacccacgcgtccggctgcgcgcaggccgggaacacgaggccaagagccgcagccccagccgccttggtgcagcgtacaccggcactagcccgcttgcagccccaggattagacagaagacgcgtcctcggcgcggtcgccgcccagccgtagtcacctggattacctacagcggcagctgcagcggagccagcgagaaggccaaaggggagcagcgtcccgagaggagcgcctcttttcagggaccccgccggctggcggacgcgcgggaaagcggcgtcgcgaacagagccagattgagggcccgcgggtggagagagcgacgcccgaggggatggcggcagcgtcccggagcgcctctggctgggcgctactgctgctggtggcactttggcagcagcgcgcggccggctccggcgtcttccagctgcagctgcaggagttcatcaactagcgcggcgtactggccagtgggcggccttgcgagcccggctgccggactttcttccgcgtctgccttaagcacttccaggcggtcgtctcgcccggaccctgcaccttcgggaccgtctccacgccggtattgggcaccaactccttcgctgtccgggacgacagtagcggcggggggcgcaaccctctccaactgcccttcaatttcacctggccgggtaccttctcgctcatcatcgaagcttggcacgcgccaggagacgacctgcggccagaggccttgccaccagatgcactcatcagcaagatcgccatccagggctccctagctgtgggtcagaactggttattggatgagcaaaccagcaccctcacaaggctgcgctactcttaccgggtcatctgcagtgacaactactatggagacaactgctcccgcctgtgcaagaagcgcaatgaccacttcggccactatgtgtgccagccagatggcaacttgtcctgcctgcccggttggactggggaatattgccaacagcctatctgtctttcgggctgtcatgaacagaatggctactgcagcaagccagcagagtgcctctgccgcccaggctggcagggccggctgtgtaacgaatgcatcccccacaatggctgtcgccacggcacctgcagcactccctggcaatgtacttgtgatgagggctggggaggcctgttttgtgaccaagatctcaactactgcacccaccactccccatgcaagaatggggcaacgtgctccaacagtgggcagcgaagctacacctgcacctgtcgcccaggctacactggtgtggactgtgagctggagctcagcgagtgtgacagcaacccctgtcgcaatggaggcagctgtaaggaccaggaggatggctaccactgcctgtgtcctccgggctactatggcctgcattgtgaacacagcaccttgagctgcgccgactccccctgcttcaatgggggctcctgccgggagcgcaaccagggggccaactatgcttgtgaatgtccccccaacttcaccggctccaactgcgagaagaaagtggacaggtgcaccagcaacccctgtgccaacgggggacagtgcctgaaccgaggtccaagccgcatgtgccgctgccgtcctggattcacgggcacctactgtgaactccacgtcagcgactgtgcccgtaacccttgcgcccacggtggcacttgccatgacctggagaatgggctcatgtgcacctgccctgccggcttctctggccgacgctgtgaggtgcggacatccatcgatgcctgtgcctcgagtccctgcttcaacagggccacctgctacaccgacctctccacagacacctttgtgtgcaactgcccttatggctttgtgggcagccgctgcgagttccccgtgggcttgccgcccagcttcccctgggtggccgtctcgctgggtgtggggctggcagtgctgctggtactgctgggcatggtggcagtggctgtgcggcagctgcggcttcgacggccggacgacggcagcagggaagccatgaacaacttgtcggacttccagaaggacaacctgattcctgccgcccagcttaaaaacacaaaccagaagaaggagctggaagtggactgtggcctggacaagtccaactgtggcaaacagcaaaaccacacattggactataatctggccccagggcccctggggcgggggaccatgccaggaaagtttccccacagtgacaagagcttaggagagaaggcgccactgcggttacacagtgaaaagccagagtgtcggatatcagcgatgtgctcccccagggactccatgtaccagtctgtgtgtttgatatcagaggagaggaatgaatgtgtcattgccacggaggtataaggcaggagcctacctggacatccctgctcagccccgcggctggaccttccttctgcattgtttacattgcatcctggatgggacgtttttcatatgcaacgtgctgctctcaggaggaggagggaatggcaggaaccggacagactgtgaacttgccaagagatgcaatacccttccacacctttgggtgtctgtctggcatcagattggcagctgcaccaaccagaggaacagaagagaagagagtggcagtagccccatggggcccggagctgctgtggcctccactggcatccgtgtttccaaaagtgcctttggcccagccaagggtgccaggcctaactggggcactcagggcagtgtgttggaaattccactgagggggaaatcaggtgctgcggccgc

SEQ ID NO: 30 - protein, 39 aa, Homo Sapiens
MAAASRSASGWALLLLVALWQQRAAGSGVFQLQLQEFIN

SEQ ID NO: 31 - DNA, 2800 bp, Homo Sapiens
  CDS (338)...(2395)
gtcgacccacgcgtccggctgcgcgcaggccgggaacacgaggccaagagccgcagccccagccgccttggtgcagcgtacaccggcactagcccgcttgcagccccaggattagacagaagacgcgtcctcggcgcggtcgccgcccagccgtagtcacctggattacctacagcggcagctgcagcggagccagcgagaaggccaaaggggagcagcgtcccgagaggagcgcctcttttcagggaccccgccggctggcggacgcgcgggaaagcggcgtcgcgaacagagccagattgagggcccgcgggtggagagagcgacgcccgaggggatggcggcagcgtcccggagcgcctctggctgggcgctactgctgctggtggcactttggcagcagcgcgcggccggctccggcgtcttccagctgcagctgcaggagttcatcaacaagcgcggcgtactggccagtgggcggccttgcgagcccggctgccggactttcttccgcgtctgccttaagcacttccaggcggtcgtctcgcccggaccctgcaccttcgggaccgtctccacgccggtattgggcaccaactccttcgctgtccgggacgacagtagcggcggggggcgcaaccctctccaactgcccttcaatttcacctggccgggtaccttctcgctcatcatcgaagcttggcacgcgccaggagacgacctgcggccagaggccttgccaccagatgcactcatcagcaagatcgccatccagggctccctagctgtgggtcagaactggttattggatgagcaaaccagcaccctcacaaggctgcgctactcttaccgggtcatctgcagtgacaactactatggagacaactgctcccgcctgtgcaagaagcgcaatgaccacttcggccactatgtgtgccagccagatggcaacttgtcctgcctgcccggttggactggggaatattgccaacagcctatctgtctttcgggctgtcatgaacagaatggctactgcagcaagccagcagagtgcctctgccgcccaggctggcagggccggctgtgtaacgaatgcatcccccacaatggctgtcgccacggcacctgcagcactccctggcaatgtacttgtgatgagggctggggaggcctgttttgtgaccaagatctcaactactgcacccaccactccccatgcaagaatggggcaacgtgctccaacagtgggcagcgaagctacacctgcacctgtcgcccaggctacactggtgtggactgtgagctggagctcagcgagtgtgacagcaacccctgtcgcaatggaggcagctgtaaggaccaggaggatggctaccactgcctgtgtcctccgggctactatggcctgcattgtgaacacagcaccttgagctgcgccgactccccctgcttcaatgggggctcctgccgggagcgcaaccagggggccaactatgcttgtgaatgtccccccaacttcaccggctccaactgcgagaagaaagtggacaggtgcaccagcaacccctgtgccaacgggggacagtgcctgaaccgaggtccaagccgcatgtgccgctgccgtcctggattcacgggcacctactgtgaactccacgtcagcgactgtgcccgtaacccttgcgcccacggtggcacttgccatgacctggagaatgggctcatgtgcacctgccctgccggcttctctggccgacgctgtgaggtgcggacatccatcgatgcctgtgcctcgagtccctgcttcaacagggccacctgctacaccgacctctccacagacacctttgtgtgcaactgcccttatggctttgtgggcagccgctgcgagttccccgtgggcttgccgcccagcttcccctgggtggccgtctcgctgggtgtggggctggcagtgctgctggtactgctgggcatggtggcagtggctgtgcggcagctgcggcttcgacggccggacgacggcagcagggaagccatgaacaacttgtcggacttccagaaggacaacctgattcctgccgcccagcttaaaaacacaaaccagaagaaggagctggaagtggactgtggcctggacaagtccaactgtggcaaacagcaaaaccacacattggactataatctggccccagggcccctggggcgggggaccatgccaggaaagtttccccacagtgacaagagcttaggagagaaggcgccactgcggttacacagtgaaaagccagagtgtcggatatcagcgatgtgctcccccagggactccatgtaccagtctgtgtgtttgatatcagaggagaggaatgaatgtgtcattgccacggaggtataaggcaggagcctacctggacatccctgctcagccccgcggctggaccttccttctgcattgtttacattgcatcctggatgggacgtttttcatatgcaacgtgctgctctcaggaggaggagggaatggcaggaaccggacagactgtgaacttgccaagagatgcaatacccttccacacctttgggtgtctgtctggcatcagattggcagctgcaccaaccagaggaacagaagagaagagagtggcagtagccccatggggcccggagctgctgtggcctccactggcatccgtgtttccaaaagtgcctttggcccagccaagggtgccaggcctaactggggcactcagggcagtgtgttggaaattccactgagggggaaatcaggtgctgcggccgc

SEQ ID NO: 32 - protein, 685 aa, Homo Sapiens
MAAASRSASGWALLLLVALWQQRAAGSGVFQLQLQEFINKRGVLASGRPCEPGCRTFFRVCLKHFQAVVSPGPCTFGTVSTPVLGTNSFAVRDDSSGGGRNPLQLPFNFTWPGTFSLIIEAWHAPGDDLRPEALPPDALISKIAIQGSLAVGQNWLLDEQTSTLTRLRYSYRVICSDNYYGDNCSRLCKKRNDHFGHYVCQPDGNLSCLPGWTGEYCQQPICLSGCHEQNGYCSKPAECLCRPGWQGRLCNECIPHNGCRHGTCSTPWQCTCDEGWGGLFCDQDLNYCTHHSPCKNGATCSNSGQRSYTCTCRPGYTGVDCELELSECDSNPCRNGGSCKDQEDGYHCLCPPGYYGLHCEHSTLSCADSPCFNGGSCRERNQGANYACECPPNFTGSNCEKKVDRCTSNPCANGGQCLNRGPSRMCRCRPGFTGTYCELHVSDCARNPCAHGGTCHDLENGLMCTCPAGFSGRRCEVRTSIDACASSPCFNRATCYTDLSTDTFVCNCPYGFVGSRCEFPVGLPPSFPWVAVSLGVGLAVLLVLLGMVAVAVRQLRLRRPDDGSREAMNNLSDFQKDNLIPAAQLKNTNQKKELEVDCGLDKSNCGKQQNHTLDYNLAPGPLGRGTMPGKFPHSDKSLGEKAPLRLHSEKPECRISAMCSPRDSMYQSVCLISEERNECVIATEV

SEQ ID NO: 33 - DNA, 2800 bp, Homo Sapiens
  CDS (338)...(2395)
gtcgacccacgcgtccggctgcgcgcaggccgggaacacgaggccaagagccgcagccccagccgccttggtgcagcgtacaccggcactagcccgcttgcagccccaggattagacagaagacgcgtcctcggcgcggtcgccgcccagccgtagtcacctggattacctacagcggcagctgcagcggagccagcgagaaggccaaaggggagcagcgtcccgagaggagcgcctcttttcagggaccccgccggctggcggacgcgcgggaaagcggcgtcgcgaacagagccagattgagggcccgcgggtggagagagcgacgcccgaggggatggcggcagcgtcccggagcgcctctggctgggcgctactgctgctggtggcactttggcagcagcgcgcggccggctccggcgtcttccagctgcagctgcaggagttcatcaacgagcgcggcgtactggccagtgggcggccttgcgagcccggctgccggactttcttccgcgtctgccttaagcacttccaggcggtcgtctcgcccggaccctgcaccttcgggaccgtctccacgccggtattgggcaccaactccttcgctgtccgggacgacagtagcggcggggggcgcaaccctctccaactgcccttcaatttcacctggccgggtaccttctcgctcatcatcgaagcttggcacgcgccaggagacgacctgcggccagaggccttgccaccagatgcactcatcagcaagatcgccatccagggctccctagttgtgggtcagaactggttattggatgagcaaaccagcaccctcacaaggctgcgctactcttaccgggtcatctgcagtgacaactactatggagacaactgctcccgcctgtgcaagaagcgcaatgaccacttcggccactatgtgtgccagccagatggcaacttgtcctgcctgcccggttggactggggaatattgccaacagcctatctgtctttcgggctgtcatgaacagaatggctactgcagcaagccagcagagtgcctctgccgcccaggctggcagggccggctgtgtaacgaatgcatcccccacaatggctgtcgccacggcacctgcagcactccctggcaatgtacttgtgatgagggctggggaggcctgttttgtgaccaagatctcaactactgcacccaccactccccatgcaagaatggggcaacgtgctccaacagtgggcagcgaagctacacctgcacctgtcgcccaggctacactggtgtggactgtgagctggagctcagcgagtgtgacagcaacccctgtcgcaatggaggcagctgtaaggaccaggaggatggctaccactgcctgtgtcctccgggctactatggcctgcattgtgaacacagcaccttgagctgcgccgactccccctgcttcaatgggggctcctgccgggagcgcaaccagggggccaactatgcttgtgaatgtccccccaacttcaccggctccaactgcgagaagaaagtggacaggtgcaccagcaacccctgtgccaacgggggacagtgcctgaaccgaggtccaagccgcatgtgccgctgccgtcctggattcacgggcacctactgtgaactccacgtcagcgactgtgcccgtaacccttgcgcccacggtggcacttgccatgacctggagaatgggctcatgtgcacctgccctgccggcttctctggccgacgctgtgaggtgcggacatccatcgatgcctgtgcctcgagtccctgcttcaacagggccacctgctacaccgacctctccacagacacctttgtgtgcaactgcccttatggctttgtgggcagccgctgcgagttccccgtgggcttgccgcccagcttcccctgggtggccgtctcgctgggtgtggggctggcagtgctgctggtactgctgggcatggtggcagtggctgtgcggcagctgcggcttcgacggccggacgacggcagcagggaagccatgaacaacttgtcggacttccagaaggacaacctgattcctgccgcccagcttaaaaacacaaaccagaagaaggagctggaagtggactgtggcctggacaagtccaactgtggcaaacagcaaaaccacacattggactataatctggccccagggcccctggggcgggggaccatgccaggaaagtttccccacagtgacaagagcttaggagagaaggcgccactgcggttacacagtgaaaagccagagtgtcggatatcagcgatgtgctcccccagggactccatgtaccagtctgtgtgtttgatatcagaggagaggaatgaatgtgtcattgccacggaggtataaggcaggagcctacctggacatccctgctcagccccgcggctggaccttccttctgcattgtttacattgcatcctggatgggacgtttttcatatgcaacgtgctgctctcaggaggaggagggaatggcaggaaccggacagactgtgaacttgccaagagatgcaatacccttccacacctttgggtgtctgtctggcatcagattggcagctgcaccaaccagaggaacagaagagaagagagtggcagtagccccatggggcccggagctgctgtggcctccactggcatccgtgtttccaaaagtgcctttggcccagccaagggtgccaggcctaactggggcactcagggcagtgtgttggaaattccactgagggggaaatcaggtgctgcggccgc

SEQ ID NO: 34 - protein, 685 aa, Homo Sapiens
MAAASRSASGWALLLLVALWQQRAAGSGVFQLQLQEFINERGVLASGRPCEPGCRTFFRVCLKHFQAVVSPGPCTFGTVSTPVLGTNSFAVRDDSSGGGRNPLQLPFNFTWPGTFSLIIEAWHAPGDDLRPEALPPDALISKIAIQGSLVVGQNWLLDEQTSTLTRLRYSYRVICSDNYYGDNCSRLCKKRNDHFGHYVCQPDGNLSCLPGWTGEYCQQPICLSGCHEQNGYCSKPAECLCRPGWQGRLCNECIPHNGCRHGTCSTPWQCTCDEGWGGLFCDQDLNYCTHHSPCKNGATCSNSGQRSYTCTCRPGYTGVDCELELSECDSNPCRNGGSCKDQEDGYHCLCPPGYYGLHCEHSTLSCADSPCFNGGSCRERNQGANYACECPPNFTGSNCEKKVDRCTSNPCANGGQCLNRGPSRMCRCRPGFTGTYCELHVSDCARNPCAHGGTCHDLENGLMCTCPAGFSGRRCEVRTSIDACASSPCFNRATCYTDLSTDTFVCNCPYGFVGSRCEFPVGLPPSFPWVAVSLGVGLAVLLVLLGMVAVAVRQLRLRRPDDGSREAMNNLSDFQKDNLIPAAQLKNTNQKKELEVDCGLDKSNCGKQQNHTLDYNLAPGPLGRGTMPGKFPHSDKSLGEKAPLRLHSEKPECRISAMCSPRDSMYQSVCLISEERNECVIATEV

SEQ ID NO: 35 - DNA, 2800 bp, Homo Sapiens
  CDS (338)...(2395)
gtcgacccacgcgtccggctgcgcgcaggccgggaacacgaggccaagagccgcagccccagccgccttggtgcagcgtacaccggcactagcccgcttgcagccccaggattagacagaagacgcgtcctcggcgcggtcgccgcccagccgtagtcacctggattacctacagcggcagctgcagcggagccagcgagaaggccaaaggggagcagcgtcccgagaggagcgcctcttttcagggaccccgccggctggcggacgcgcgggaaagcggcgtcgcgaacagagccagattgagggcccgcgggtggagagagcgacgcccgaggggatggcggcagcgtcccggagcgcctctggctgggcgctactgctgctggtggcactttggcagcagcgcgcggccggctccggcgtcttccagctgcagctgcaggagttcatcaacgagcgcggcgtactggccagtgggcggccttgcgagcccggctgccggactttcttccgcgtctgccttaagcacttccaggcggtcgtctcgcccggaccctgcaccttcgggaccgtctccacgccggtattgggcagcaactccttcgctgtccgggacgacagtagcggcggggggcgcaaccctctccaactgcccttcaatttcacctggccgggtaccttctcgctcatcatcgaagcttggcacgcgccaggagacgacctgcggccagaggccttgccaccagatgcactcatcagcaagatcgccatccagggctccctagctgtgggtcagaactggttattggatgagcaaaccagcaccctcacaaggctgcgctactcttaccgggtcatctgcagtgacaactactatggagacaactgctcccgcctgtgcaagaagcgcaatgaccacttcggccactatgtgtgccagccagatggcaacttgtcctgcctgcccggttggactggggaatattgccaacagcctatctgtctttcgggctgtcatgaacagaatggctactgcagcaagccagcagagtgcctctgccgcccaggctggcagggccggctgtgtaacgaatgcatcccccacaatggctgtcgccacggcacctgcagcactccctggcaatgtacttgtgatgagggctggggaggcctgttttgtgaccaagatctcaactactgcacccaccactccccatgcaagaatggggcaacgtgctccaacagtgggcagcgaagctacacctgcacctgtcgcccaggctacactggtgtggactgtgagctggagctcagcgagtgtgacagcaacccctgtcgcaatggaggcagctgtaaggaccaggaggatggctaccactgcctgtgtcctccgggctactatggcctgcattgtgaacacagcaccttgagctgcgccgactccccctgcttcaatgggggctcctgccgggagcgcaaccagggggccaactatgcttgtgaatgtccccccaacttcaccggctccaactgcgagaagaaagtggacaggtgcaccagcaacccctgtgccaacgggggacagtgcctgaaccgaggtccaagccgcatgtgccgctgccgtcctggattcacgggcacctactgtgaactccacgtcagcgactgtgcccgtaacccttgcgcccacggtggcacttgccatgacctggagaatgggctcatgtgcacctgccctgccggcttctctggccgacgctgtgaggtgcggacatccatcgatgcctgtgcctcgagtccctgcttcaacagggccacctgctacaccgacctctccacagacacctttgtgtgcaactgcccttatggctttgtgggcagccgctgcgagttccccgtgggcttgccgcccagcttcccctgggtggccgtctcgctgggtgtggggctggcagtgctgctggtactgctgggcatggtggcagtggctgtgcggcagctgcggcttcgacggccggacgacggcagcagggaagccatgaacaacttgtcggacttccagaaggacaacctgattcctgccgcccagcttaaaaacacaaaccagaagaaggagctggaagtggactgtggcctggacaagtccaactgtggcaaacagcaaaaccacacattggactataatctggccccagggcccctggggcgggggaccatgccaggaaagtttccccacagtgacaagagcttaggagagaaggcgccactgcggttacacagtgaaaagccagagtgtcggatatcagcgatgtgctcccccagggactccatgtaccagtctgtgtgtttgatatcagaggagaggaatgaatgtgtcattgccacggaggtataaggcaggagcctacctggacatccctgctcagccccgcggctggaccttccttctgcattgtttacattgcatcctggatgggacgtttttcatatgcaacgtgctgctctcaggaggaggagggaatggcaggaaccggacagactgtgaacttgccaagagatgcaatacccttccacacctttgggtgtctgtctggcatcagattggcagctgcaccaaccagaggaacagaagagaagagagtggcagtagccccatggggcccggagctgctgtggcctccactggcatccgtgtttccaaaagtgcctttggcccagccaagggtgccaggcctaactggggcactcagggcagtgtgttggaaattccactgagggggaaatcaggtgctgcggccgc

SEQ ID NO: 36 - protein, 685 aa, Homo Sapiens
MAAASRSASGWALLLLVALWQQRAAGSGVFQLQLQEFINERGVLASGRPCEPGCRTFFRVCLKHFQAVVSPGPCTFGTVSTPVLGSNSFAVRDDSSGGGRNPLQLPFNFTWPGTFSLIIEAWHAPGDDLRPEALPPDALISKIAIQGSLAVGQNWLLDEQTSTLTRLRYSYRVICSDNYYGDNCSRLCKKRNDHFGHYVCQPDGNLSCLPGWTGEYCQQPICLSGCHEQNGYCSKPAECLCRPGWQGRLCNECIPHNGCRHGTCSTPWQCTCDEGWGGLFCDQDLNYCTHHSPCKNGATCSNSGQRSYTCTCRPGYTGVDCELELSECDSNPCRNGGSCKDQEDGYHCLCPPGYYGLHCEHSTLSCADSPCFNGGSCRERNQGANYACECPPNFTGSNCEKKVDRCTSNPCANGGQCLNRGPSRMCRCRPGFTGTYCELHVSDCARNPCAHGGTCHDLENGLMCTCPAGFSGRRCEVRTSIDACASSPCFNRATCYTDLSTDTFVCNCPYGFVGSRCEFPVGLPPSFPWVAVSLGVGLAVLLVLLGMVAVAVRQLRLRRPDDGSREAMNNLSDFQKDNLIPAAQLKNTNQKKELEVDCGLDKSNCGKQQNHTLDYNLAPGPLGRGTMPGKFPHSDKSLGEKAPLRLHSEKPECRISAMCSPRDSMYQSVCLISEERNECVIATEV

SEQ ID NO: 37 - DNA, 2800 bp, Homo Sapiens
  CDS (338)...(2395)
gtcgacccacgcgtccggctgcgcgcaggccgggaacacgaggccaagagccgcagccccagccgccttggtgcagcgtacaccggcactagcccgcttgcagccccaggattagacagaagacgcgtcctcggcgcggtcgccgcccagccgtagtcacctggattacctacagcggcagctgcagcggagccagcgagaaggccaaaggggagcagcgtcccgagaggagcgcctcttttcagggaccccgccggctggcggacgcgcgggaaagcggcgtcgcgaacagagccagattgagggcccgcgggtggagagagcgacgcccgaggggatggcggcagcgtcccggagcgcctctggctgggcgctactgctgctggtggcactttggcagcagcgcgcggccggctccggcgtcttccagctgcagctgcaggagttcatcaacgagcgcggcgtactggccagtgggcggccttgcgagcccggctgccggactttcttccgcgtctgccttaagcacttccaggcggtcgtctcgcccggaccctgcaccttcgggaccgtctccacgccggtattgggcaccaactccttcgctgtccgggacgacagtagcggcggggggcgcaaccctctccaactgcccttcaatttcacctggccgggtaccttctcgctcatcatcgaagcttggcacgcgccaggagacgacctgcggccagaggccttgccaccagatgcactcatcagcaagatcgccatccagggctccctagctgtgggtcagaactggttattggatgagcaaaccagcaccctcacaaggctgcgctactcttaccgggtcatctgcagtgacaactactatggagaaaactgctcccgcctgtgcaagaagcgcaatgaccacttcggccactatgtgtgccagccagatggcaacttgtcctgcctgcccggttggactggggaatattgccaacagcctatctgtctttcgggctgtcatgaacagaatggctactgcagcaagccagcagagtgcctctgccgcccaggctggcagggccggctgtgtaacgaatgcatcccccacaatggctgtcgccacggcacctgcagcactccctggcaatgtacttgtgatgagggctggggaggcctgttttgtgaccaagatctcaactactgcacccaccactccccatgcaagaatggggcaacgtgctccaacagtgggcagcgaagctacacctgcacctgtcgcccaggctacactggtgtggactgtgagctggagctcagcgagtgtgacagcaacccctgtcgcaatggaggcagctgtaaggaccaggaggatggctaccactgcctgtgtcctccgggctactatggcctgcattgtgaacacagcaccttgagctgcgccgactccccctgcttcaatgggggctcctgccgggagcgcaaccagggggccaactatgcttgtgaatgtccccccaacttcaccggctccaactgcgagaagaaagtggacaggtgcaccagcaacccctgtgccaacgggggacagtgcctgaaccgaggtccaagccgcatgtgccgctgccgtcctggattcacgggcacctactgtgaactccacgtcagcgactgtgcccgtaacccttgcgcccacggtggcacttgccatgacctggagaatgggctcatgtgcacctgccctgccggcttctctggccgacgctgtgaggtgcggacatccatcgatgcctgtgcctcgagtccctgcttcaacagggccacctgctacaccgacctctccacagacacctttgtgtgcaactgcccttatggctttgtgggcagccgctgcgagttccccgtgggcttgccgcccagcttcccctgggtggccgtctcgctgggtgtggggctggcagtgctgctggtactgctgggcatggtggcagtggctgtgcggcagctgcggcttcgacggccggacgacggcagcagggaagccatgaacaacttgtcggacttccagaaggacaacctgattcctgccgcccagcttaaaaacacaaaccagaagaaggagctggaagtggactgtggcctggacaagtccaactgtggcaaacagcaaaaccacacattggactataatctggccccagggcccctggggcgggggaccatgccaggaaagtttccccacagtgacaagagcttaggagagaaggcgccactgcggttacacagtgaaaagccagagtgtcggatatcagcgatgtgctcccccagggactccatgtaccagtctgtgtgtttgatatcagaggagaggaatgaatgtgtcattgccacggaggtataaggcaggagcctacctggacatccctgctcagccccgcggctggaccttccttctgcattgtttacattgcatcctggatgggacgtttttcatatgcaacgtgctgctctcaggaggaggagggaatggcaggaaccggacagactgtgaacttgccaagagatgcaatacccttccacacctttgggtgtctgtctggcatcagattggcagctgcaccaaccagaggaacagaagagaagagagtggcagtagccccatggggcccggagctgctgtggcctccactggcatccgtgtttccaaaagtgcctttggcccagccaagggtgccaggcctaactggggcactcagggcagtgtgttggaaattccactgagggggaaatcaggtgctgcggccgc

SEQ ID NO: 38 - protein, 685 aa, Homo Sapiens
MAAASRSASGWALLLLVALWQQRAAGSGVFQLQLQEFINERGVLASGRPCEPGCRTFFRVCLKHFQAVVSPGPCTFGTVSTPVLGTNSFAVRDDSSGGGRNPLQLPFNFTWPGTFSLIIEAWHAPGDDLRPEALPPDALISKIAIQGSLAVGQNWLLDEQTSTLTRLRYSYRVICSDNYYGENCSRLCKKRNDHFGHYVCQPDGNLSCLPGWTGEYCQQPICLSGCHEQNGYCSKPAECLCRPGWQGRLCNECIPHNGCRHGTCSTPWQCTCDEGWGGLFCDQDLNYCTHHSPCKNGATCSNSGQRSYTCTCRPGYTGVDCELELSECDSNPCRNGGSCKDQEDGYHCLCPPGYYGLHCEHSTLSCADSPCFNGGSCRERNQGANYACECPPNFTGSNCEKKVDRCTSNPCANGGQCLNRGPSRMCRCRPGFTGTYCELHVSDCARNPCAHGGTCHDLENGLMCTCPAGFSGRRCEVRTSIDACASSPCFNRATCYTDLSTDTFVCNCPYGFVGSRCEFPVGLPPSFPWVAVSLGVGLAVLLVLLGMVAVAVRQLRLRRPDDGSREAMNNLSDFQKDNLIPAAQLKNTNQKKELEVDCGLDKSNCGKQQNHTLDYNLAPGPLGRGTMPGKFPHSDKSLGEKAPLRLHSEKPECRISAMCSPRDSMYQSVCLISEERNECVIATEV

SEQ ID NO: 39 - DNA, 3133 bp, Mus Musculus
  CDS (39)...(2099)
gtcgacccacgcgtccggtggagaggacaccccaagggatgacgcctgtgtcccggagcgcctgtcgctgggcgctactgctgctggcggtactgtggccgcagcagcgcgctgcgggctccggcatcttccagctgcggctgcaggagttcgtcaaccagcgcggtatgctggccaatgggcagtcctgcgaaccgggctgccggactttcttccgcatctgccttaagcacttccaggcaaccttctccgagggaccctgcacctttggcaatgtctccacgccggtattgggcaccaactccttcgtcgtcagggacaagaatagcggcagtggtcgcaaccctctgcagttgcccttcaatttcacctggccgggaaccttctcactcaacatccaagcttggcacacaccgggagacgacctgcggccagagacttcgccaggaaactctctcatcagccaaatcatcatccaaggctctcttgctgtgggtaagatttggcgaacagacgagcaaaatgacaccctcaccagactgagctactcttaccgggtcatctgcagtgacaactactatggagagagctgttctcgcctatgcaagaagcgcgatgaccacttcggacattatgagtgccagccagatggcagcctgtcctgcctgccgggctggactgggaagtactgtgaccagcctatatgtctttctggctgtcatgagcagaatggttactgcagcaagccagatgagtgcatctgccgtccaggttggcagggtcgcctgtgcaatgaatgtatcccccacaatggctgtcgtcatggcacctgcagcatcccctggcagtgtgcctgcgatgagggatggggaggtctgttttgtgaccaagatctcaactactgtactcaccactctccgtgcaagaatggatcaacgtgttccaacagtgggccaaagggttatacctgcacctgtctcccaggctacactggtgagcactgtgagctgggactcagcaagtgtgccagcaacccctgtcgaaatggtggcagctgtaaggaccaggagaatagctaccactgcctgtgtcccccaggctactatggccagcactgtgagcatagtaccttgacctgcgcggactcaccctgcttcaatgggggctcttgccgggagcgcaaccaggggtccagttatgcctgcgaatgcccccccaactttaccggctctaactgtgagaagaaagtagacaggtgtaccagcaacccgtgtgccaatggaggccagtgccagaacagaggtccaagccgaacctgccgctgccggcctggattcacaggcacccactgtgaactgcacatcagcgattgtgcccgaagtccctgtgcccacgggggcacttgccacgatctggagaatgggcctgtgtgcacctgccccgctggcttctctggaaggcgctgcgaggtgcggataacccacgatgcctgtgcctccggaccctgcttcaatggggccacctgctacactggcctctccccaaacaacttcgtctgcaactgtccttatggctttgtgggcagccgctgcgagtttcccgtgggcttgccacccagcttcccctgggtagctgtctcgctgggcgtggggctagtggtactgctggtgctcctggtcatggtggtagtggctgtgcggcagctgcggcttcggaggcccgatgacgagagcagggaagccatgaacaatctgtcagacttccagaaggacaacctaatccctgccgcccagctcaaaaacacaaaccagaagaaggagctggaagtggactgtggtctggacaagtccaattgtggcaaactgcagaaccacacattggactacaatctagccccgggactcctaggacggggcggcatgcctgggaagtatcctcacagtgacaagagcttaggagagaaggtgccacttcggttacacagtgagaagccagagtgtcgaatatcagccatttgctctcccagggactctatgtaccaatcagtgtgtttgatatcagaagagaggaacgagtgtgtgattgccacagaggtataaggcaggagcctactcagacacccagctccggcccagcagctgggccttccttctgcattgtttacattgcatcctgtatgggacatctttagtatgcacagtgctgctctgcggaggaggaggaaatggcatgaactgaacagactgtgaacccgccaagagtcgcaccggctctgcacacctccaggagtctgcctggcttcagatgggcagccccgccaagggaacagagttgaggagttagaggagcatcagttgagctgatatctaaggtgcctctcgaacttggacttgctctgccaacagtggtcatcatggagctcttgactgttctccagagagtggcagtggccctagtgggtcttggcgctgctgtagctcctgtgggcatctgtatttccaaagtgcctttgcccagactccatcctcacagctgggcccaaatgagaaagcagagaggaggcttgcaaaggataggcctcccgcaggcagaacagccttggagtttggcattaagcaggagctactctgcaggtgaggaaagcccgaggaggggacacgtgtgactcctgcctccaaccccagtaggtggagtgccacctgtagcctctaggcaagagttggtccttcccctggtcctggtgcctctgggctcatgtgaacagatgggcttagggcacgccccttttgccagccaggggtacaggcctcactggggagctcagggccttcatgctaaactcccaataagggagatggggggaagggggctgtggcctaggcccttccctccctcacacccatttctgggcccttgagcctgggctccaccagtgcccactgctgccccgagaccaaccttgaagccgatcttcaaaaatcaataatatgaggttttgttttgtagtttattttggaatctagtattttgataatttaagaatcagaagcactggcctttctacattttataacattattttgtatataatgtgtatttataatatgaaaaaaaaaaaaaaaagggcggccgc

SEQ ID NO: 40 - protein, 686 aa, Mus Musculus
MTPVSRSACRWALLLLAVLWPQQRAAGSGIFQLRLQEFVNQRGMLANGQSCEPGCRTFFRICLKHFQATFSEGPCTFGNVSTPVLGTNSFVVRDKNSGSGRNPLQLPFNFTWPGTFSLNIQAWHTPGDDLRPETSPGNSLISQIIIQGSLAVGKIWRTDEQNDTLTRLSYSYRVICSDNYYGESCSRLCKKRDDHFGHYECQPDGSLSCLPGWTGKYCDQPICLSGCHEQNGYCSKPDECICRPGWQGRLCNECIPHNGCRHGTCSIPWQCACDEGWGGLFCDQDLNYCTHHSPCKNGSTCSNSGPKGYTCTCLPGYTGEHCELGLSKCASNPCRNGGSCKDQENSYHCLCPPGYYGQHCEHSTLTCADSPCFNGGSCRERNQGSSYACECPPNFTGSNCEKKVDRCTSNPCANGGQCQNRGPSRTCRCRPGFTGTHCELHISDCARSPCAHGGTCHDLENGPVCTCPAGFSGRRCEVRITHDACASGPCFNGATCYTGLSPNNFVCNCPYGFVGSRCEFPVGLPPSFPWVAVSLGVGLVVLLVLLVMVVVAVRQLRLRRPDDESREAMNNLSDFQKDNLIPAAQLKNTNQKKELEVDCGLDKSNCGKLQNHTLDYNLAPGLLGRGGMPGKYPHSDKSLGEKVPLRLHSEKPECRISAICSPRDSMYQSVCLISEERNECVIATEV

SEQ ID NO: 41 - DNA, 3133 bp, Mus Musculus
  CDS (39)...(2099)
gtcgacccacgcgtccggtggagaggacaccccaagggatgacgcctgcgacccggagcgcctgtcgctgggcgctactgctgctggcggtactgtggccgcagcagcgcgctgcgggctccggcatcttccagctgcggctgcaggagttcgtcaaccagcgcggtatgctggccaatgggcagtcctgcgaaccgggctgccggactttcttccgcatctgccttaagcacttccaggcaaccttctccgagggaccctgcacctttggcaatgtctccacgccggtattgggcaccaactccttcgtcgtcagggacaagaatagcggcagtggtcgcaaccctctgcagttgcccttcaatttcacctggccgggaaccttctcactcaacatccaagcttggcacacaccgggagacgacctgcggccagagacttcgccaggaaactctctcatcagccaaatcatcatccaaggctctcttgctgtgggtaagatttggcgaacagacgagcaaaatgacaccctcaccagactgagctactcttaccgggtcatctgcagtgacaactactatggagagagctgttctcgcctatgcaagaagcgcgatgaccacttcggacattatgagtgccagccagatggcagcctgtcctgcctgccgggctggactgggaagtactgtgaccagcctatatgtctttctggctgtcatgagcagaatggttactgcagcaagccagatgagtgcatctgccgtccaggttggcagggtcgcctgtgcaatgaatgtatcccccacaatggctgtcgtcatggcacctgcagcatcccctggcagtgtgcctgcgatgagggatggggaggtctgttttgtgaccaagatctcaactactgtactcaccactctccgtgcaagaatggatcaacgtgttccaacagtgggccaaagggttatacctgcacctgtctcccaggctacactggtgagcactgtgagctgggactcagcaagtgtgccagcaacccctgtcgaaatggtggcagctgtaaggaccaggagaatagctaccactgcctgtgtcccccaggctactatggccagcactgtgagcatagtaccttgacctgcgcggactcaccctgcttcaatgggggctcttgccgggagcgcaaccaggggtccagttatgcctgcgaatgcccccccaactttaccggctctaactgtgagaagaaagtagacaggtgtaccagcaacccgtgtgccaatggaggccagtgccagaacagaggtccaagccgaacctgccgctgccggcctggattcacaggcacccactgtgaactgcacatcagcgattgtgcccgaagtccctgtgcccacgggggcacttgccacgatctggagaatgggcctgtgtgcacctgccccgctggcttctctggaaggcgctgcgaggtgcggataacccacgatgcctgtgcctccggaccctgcttcaatggggccacctgctacactggcctctccccaaacaacttcgtctgcaactgtccttatggctttgtgggcagccgctgcgagtttcccgtgggcttgccacccagcttcccctgggtagctgtctcgctgggcgtggggctagtggtactgctggtgctcctggtcatggtggtagtggctgtgcggcagctgcggcttcggaggcccgatgacgagagcagggaagccatgaacaatctgtcagacttccagaaggacaacctaatccctgccgcccagctcaaaaacacaaaccagaagaaggagctggaagtggactgtggtctggacaagtccaattgtggcaaactgcagaaccacacattggactacaatctagccccgggactcctaggacggggcggcatgcctgggaagtatcctcacagtgacaagagcttaggagagaaggtgccacttcggttacacagtgagaagccagagtgtcgaatatcagccatttgctctcccagggactctatgtaccaatcagtgtgtttgatatcagaagagaggaacgagtgtgtgattgccacagaggtataaggcaggagcctactcagacacccagctccggcccagcagctgggccttccttctgcattgtttacattgcatcctgtatgggacatctttagtatgcacagtgctgctctgcggaggaggaggaaatggcatgaactgaacagactgtgaacccgccaagagtcgcaccggctctgcacacctccaggagtctgcctggcttcagatgggcagccccgccaagggaacagagttgaggagttagaggagcatcagttgagctgatatctaaggtgcctctcgaacttggacttgctctgccaacagtggtcatcatggagctcttgactgttctccagagagtggcagtggccctagtgggtcttggcgctgctgtagctcctgtgggcatctgtatttccaaagtgcctttgcccagactccatcctcacagctgggcccaaatgagaaagcagagaggaggcttgcaaaggataggcctcccgcaggcagaacagccttggagtttggcattaagcaggagctactctgcaggtgaggaaagcccgaggaggggacacgtgtgactcctgcctccaaccccagtaggtggagtgccacctgtagcctctaggcaagagttggtccttcccctggtcctggtgcctctgggctcatgtgaacagatgggcttagggcacgccccttttgccagccaggggtacaggcctcactggggagctcagggccttcatgctaaactcccaataagggagatggggggaagggggctgtggcctaggcccttccctccctcacacccatttctgggcccttgagcctgggctccaccagtgcccactgctgccccgagaccaaccttgaagccgatcttcaaaaatcaataatatgaggttttgttttgtagtttattttggaatctagtattttgataatttaagaatcagaagcactggcctttctacattttataacattattttgtatataatgtgtatttataatatgaaaaaaaaaaaaaaaagggcggccgc

SEQ ID NO: 42 - protein, 686 aa, Mus Musculus
MTPATRSACRWALLLLAVLWPQQRAAGSGIFQLRLQEFVNQRGMLANGQSCEPGCRTFFRICLKHFQATFSEGPCTFGNVSTPVLGTNSFVVRDKNSGSGRNPLQLPFNFTWPGTFSLNIQAWHTPGDDLRPETSPGNSLISQIIIQGSLAVGKIWRTDEQNDTLTRLSYSYRVICSDNYYGESCSRLCKKRDDHFGHYECQPDGSLSCLPGWTGKYCDQPICLSGCHEQNGYCSKPDECICRPGWQGRLCNECIPHNGCRHGTCSIPWQCACDEGWGGLFCDQDLNYCTHHSPCKNGSTCSNSGPKGYTCTCLPGYTGEHCELGLSKCASNPCRNGGSCKDQENSYHCLCPPGYYGQHCEHSTLTCADSPCFNGGSCRERNQGSSYACECPPNFTGSNCEKKVDRCTSNPCANGGQCQNRGPSRTCRCRPGFTGTHCELHISDCARSPCAHGGTCHDLENGPVCTCPAGFSGRRCEVRITHDACASGPCFNGATCYTGLSPNNFVCNCPYGFVGSRCEFPVGLPPSFPWVAVSLGVGLVVLLVLLVMVVVAVRQLRLRRPDDESREAMNNLSDFQKDNLIPAAQLKNTNQKKELEVDCGLDKSNCGKLQNHTLDYNLAPGLLGRGGMPGKYPHSDKSLGEKVPLRLHSEKPECRISAICSPRDSMYQSVCLISEERNECVIATEV

SEQ ID NO: 43 - DNA, 3133 bp, Mus Musculus
  CDS (39)...(2099)
gtcgacccacgcgtccggtggagaggacaccccaagggatgacgcctgcgtcccggagcgcctgtcgctgggcgctactgctgctggcggtactgtggccgcagcagcacgctgcgggctccggcatcttccagctgcggctgcaggagttcgtcaaccagcgcggtatgctggccaatgggcagtcctgcgaaccgggctgccggactttcttccgcatctgccttaagcacttccaggcaaccttctccgagggaccctgcacctttggcaatgtctccacgccggtattgggcaccaactccttcgtcgtcagggacaagaatagcggcagtggtcgcaaccctctgcagttgcccttcaatttcacctggccgggaaccttctcactcaacatccaagcttggcacacaccgggagacgacctgcggccagagacttcgccaggaaactctctcatcagccaaatcatcatccaaggctctcttgctgtgggtaagatttggcgaacagacgagcaaaatgacaccctcaccagactgagctactcttaccgggtcatctgcagtgacaactactatggagagagctgttctcgcctatgcaagaagcgcgatgaccacttcggacattatgagtgccagccagatggcagcctgtcctgcctgccgggctggactgggaagtactgtgaccagcctatatgtctttctggctgtcatgagcagaatggttactgcagcaagccagatgagtgcatctgccgtccaggttggcagggtcgcctgtgcaatgaatgtatcccccacaatggctgtcgtcatggcacctgcagcatcccctggcagtgtgcctgcgatgagggatggggaggtctgttttgtgaccaagatctcaactactgtactcaccactctccgtgcaagaatggatcaacgtgttccaacagtgggccaaagggttatacctgcacctgtctcccaggctacactggtgagcactgtgagctgggactcagcaagtgtgccagcaacccctgtcgaaatggtggcagctgtaaggaccaggagaatagctaccactgcctgtgtcccccaggctactatggccagcactgtgagcatagtaccttgacctgcgcggactcaccctgcttcaatgggggctcttgccgggagcgcaaccaggggtccagttatgcctgcgaatgcccccccaactttaccggctctaactgtgagaagaaagtagacaggtgtaccagcaacccgtgtgccaatggaggccagtgccagaacagaggtccaagccgaacctgccgctgccggcctggattcacaggcacccactgtgaactgcacatcagcgattgtgcccgaagtccctgtgcccacgggggcacttgccacgatctggagaatgggcctgtgtgcacctgccccgctggcttctctggaaggcgctgcgaggtgcggataacccacgatgcctgtgcctccggaccctgcttcaatggggccacctgctacactggcctctccccaaacaacttcgtctgcaactgtccttatggctttgtgggcagccgctgcgagtttcccgtgggcttgccacccagcttcccctgggtagctgtctcgctgggcgtggggctagtggtactgctggtgctcctggtcatggtggtagtggctgtgcggcagctgcggcttcggaggcccgatgacgagagcagggaagccatgaacaatctgtcagacttccagaaggacaacctaatccctgccgcccagctcaaaaacacaaaccagaagaaggagctggaagtggactgtggtctggacaagtccaattgtggcaaactgcagaaccacacattggactacaatctagccccgggactcctaggacggggcggcatgcctgggaagtatcctcacagtgacaagagcttaggagagaaggtgccacttcggttacacagtgagaagccagagtgtcgaatatcagccatttgctctcccagggactctatgtaccaatcagtgtgtttgatatcagaagagaggaacgagtgtgtgattgccacagaggtataaggcaggagcctactcagacacccagctccggcccagcagctgggccttccttctgcattgtttacattgcatcctgtatgggacatctttagtatgcacagtgctgctctgcggaggaggaggaaatggcatgaactgaacagactgtgaacccgccaagagtcgcaccggctctgcacacctccaggagtctgcctggcttcagatgggcagccccgccaagggaacagagttgaggagttagaggagcatcagttgagctgatatctaaggtgcctctcgaacttggacttgctctgccaacagtggtcatcatggagctcttgactgttctccagagagtggcagtggccctagtgggtcttggcgctgctgtagctcctgtgggcatctgtatttccaaagtgcctttgcccagactccatcctcacagctgggcccaaatgagaaagcagagaggaggcttgcaaaggataggcctcccgcaggcagaacagccttggagtttggcattaagcaggagctactctgcaggtgaggaaagcccgaggaggggacacgtgtgactcctgcctccaaccccagtaggtggagtgccacctgtagcctctaggcaagagttggtccttcccctggtcctggtgcctctgggctcatgtgaacagatgggcttagggcacgccccttttgccagccaggggtacaggcctcactggggagctcagggccttcatgctaaactcccaataagggagatggggggaagggggctgtggcctaggcccttccctccctcacacccatttctgggcccttgagcctgggctccaccagtgcccactgctgccccgagaccaaccttgaagccgatcttcaaaaatcaataatatgaggttttgttttgtagtttattttggaatctagtattttgataatttaagaatcagaagcactggcctttctacattttataacattattttgtatataatgtgtatttataatatgaaaaaaaaaaaaaaaagggcggccgc

SEQ ID NO: 44 - protein, 686 aa, Mus Musculus
MTPASRSACRWALLLLAVLWPQQHAAGSGIFQLRLQEFVNQRGMLANGQSCEPGCRTFFRICLKHFQATFSEGPCTFGNVSTPVLGTNSFVVRDKNSGSGRNPLQLPFNFTWPGTFSLNIQAWHTPGDDLRPETSPGNSLISQIIIQGSLAVGKIWRTDEQNDTLTRLSYSYRVICSDNYYGESCSRLCKKRDDHFGHYECQPDGSLSCLPGWTGKYCDQPICLSGCHEQNGYCSKPDECICRPGWQGRLCNECIPHNGCRHGTCSIPWQCACDEGWGGLFCDQDLNYCTHHSPCKNGSTCSNSGPKGYTCTCLPGYTGEHCELGLSKCASNPCRNGGSCKDQENSYHCLCPPGYYGQHCEHSTLTCADSPCFNGGSCRERNQGSSYACECPPNFTGSNCEKKVDRCTSNPCANGGQCQNRGPSRTCRCRPGFTGTHCELHISDCARSPCAHGGTCHDLENGPVCTCPAGFSGRRCEVRITHDACASGPCFNGATCYTGLSPNNFVCNCPYGFVGSRCEFPVGLPPSFPWVAVSLGVGLVVLLVLLVMVVVAVRQLRLRRPDDESREAMNNLSDFQKDNLIPAAQLKNTNQKKELEVDCGLDKSNCGKLQNHTLDYNLAPGLLGRGGMPGKYPHSDKSLGEKVPLRLHSEKPECRISAICSPRDSMYQSVCLISEERNECVIATEV

SEQ ID NO: 45 - DNA, 3133 bp, Mus Musculus
  CDS (39)...(2099)
gtcgacccacgcgtccggtggagaggacaccccaagggatgacgcctgcgtcccggagcgcctgtcgctgggcgctactgctgctggcggtactgtggccgcagcagcgcgctgcgggctccggcatctaccagctgcggctgcaggagttcgtcaaccagcgcggtatgctggccaatgggcagtcctgcgaaccgggctgccggactttcttccgcatctgccttaagcacttccaggcaaccttctccgagggaccctgcacctttggcaatgtctccacgccggtattgggcaccaactccttcgtcgtcagggacaagaatagcggcagtggtcgcaaccctctgcagttgcccttcaatttcacctggccgggaaccttctcactcaacatccaagcttggcacacaccgggagacgacctgcggccagagacttcgccaggaaactctctcatcagccaaatcatcatccaaggctctcttgctgtgggtaagatttggcgaacagacgagcaaaatgacaccctcaccagactgagctactcttaccgggtcatctgcagtgacaactactatggagagagctgttctcgcctatgcaagaagcgcgatgaccacttcggacattatgagtgccagccagatggcagcctgtcctgcctgccgggctggactgggaagtactgtgaccagcctatatgtctttctggctgtcatgagcagaatggttactgcagcaagccagatgagtgcatctgccgtccaggttggcagggtcgcctgtgcaatgaatgtatcccccacaatggctgtcgtcatggcacctgcagcatcccctggcagtgtgcctgcgatgagggatggggaggtctgttttgtgaccaagatctcaactactgtactcaccactctccgtgcaagaatggatcaacgtgttccaacagtgggccaaagggttatacctgcacctgtctcccaggctacactggtgagcactgtgagctgggactcagcaagtgtgccagcaacccctgtcgaaatggtggcagctgtaaggaccaggagaatagctaccactgcctgtgtcccccaggctactatggccagcactgtgagcatagtaccttgacctgcgcggactcaccctgcttcaatgggggctcttgccgggagcgcaaccaggggtccagttatgcctgcgaatgcccccccaactttaccggctctaactgtgagaagaaagtagacaggtgtaccagcaacccgtgtgccaatggaggccagtgccagaacagaggtccaagccgaacctgccgctgccggcctggattcacaggcacccactgtgaactgcacatcagcgattgtgcccgaagtccctgtgcccacgggggcacttgccacgatctggagaatgggcctgtgtgcacctgccccgctggcttctctggaaggcgctgcgaggtgcggataacccacgatgcctgtgcctccggaccctgcttcaatggggccacctgctacactggcctctccccaaacaacttcgtctgcaactgtccttatggctttgtgggcagccgctgcgagtttcccgtgggcttgccacccagcttcccctgggtagctgtctcgctgggcgtggggctagtggtactgctggtgctcctggtcatggtggtagtggctgtgcggcagctgcggcttcggaggcccgatgacgagagcagggaagccatgaacaatctgtcagacttccagaaggacaacctaatccctgccgcccagctcaaaaacacaaaccagaagaaggagctggaagtggactgtggtctggacaagtccaattgtggcaaactgcagaaccacacattggactacaatctagccccgggactcctaggacggggcggcatgcctgggaagtatcctcacagtgacaagagcttaggagagaaggtgccacttcggttacacagtgagaagccagagtgtcgaatatcagccatttgctctcccagggactctatgtaccaatcagtgtgtttgatatcagaagagaggaacgagtgtgtgattgccacagaggtataaggcaggagcctactcagacacccagctccggcccagcagctgggccttccttctgcattgtttacattgcatcctgtatgggacatctttagtatgcacagtgctgctctgcggaggaggaggaaatggcatgaactgaacagactgtgaacccgccaagagtcgcaccggctctgcacacctccaggagtctgcctggcttcagatgggcagccccgccaagggaacagagttgaggagttagaggagcatcagttgagctgatatctaaggtgcctctcgaacttggacttgctctgccaacagtggtcatcatggagctcttgactgttctccagagagtggcagtggccctagtgggtcttggcgctgctgtagctcctgtgggcatctgtatttccaaagtgcctttgcccagactccatcctcacagctgggcccaaatgagaaagcagagaggaggcttgcaaaggataggcctcccgcaggcagaacagccttggagtttggcattaagcaggagctactctgcaggtgaggaaagcccgaggaggggacacgtgtgactcctgcctccaaccccagtaggtggagtgccacctgtagcctctaggcaagagttggtccttcccctggtcctggtgcctctgggctcatgtgaacagatgggcttagggcacgccccttttgccagccaggggtacaggcctcactggggagctcagggccttcatgctaaactcccaataagggagatggggggaagggggctgtggcctaggcccttccctccctcacacccatttctgggcccttgagcctgggctccaccagtgcccactgctgccccgagaccaaccttgaagccgatcttcaaaaatcaataatatgaggttttgttttgtagtttattttggaatctagtattttgataatttaagaatcagaagcactggcctttctacattttataacattattttgtatataatgtgtatttataatatgaaaaaaaaaaaaaaaagggcggccgc

SEQ ID NO: 46 - protein, 686 aa, Mus Musculus
MTPASRSACRWALLLLAVLWPQQRAAGSGIYQLRLQEFVNQRGMLANGQSCEPGCRTFFRICLKHFQATFSEGPCTFGNVSTPVLGTNSFVVRDKNSGSGRNPLQLPFNFTWPGTFSLNIQAWHTPGDDLRPETSPGNSLISQIIIQGSLAVGKIWRTDEQNDTLTRLSYSYRVICSDNYYGESCSRLCKKRDDHFGHYECQPDGSLSCLPGWTGKYCDQPICLSGCHEQNGYCSKPDECICRPGWQGRLCNECIPHNGCRHGTCSIPWQCACDEGWGGLFCDQDLNYCTHHSPCKNGSTCSNSGPKGYTCTCLPGYTGEHCELGLSKCASNPCRNGGSCKDQENSYHCLCPPGYYGQHCEHSTLTCADSPCFNGGSCRERNQGSSYACECPPNFTGSNCEKKVDRCTSNPCANGGQCQNRGPSRTCRCRPGFTGTHCELHISDCARSPCAHGGTCHDLENGPVCTCPAGFSGRRCEVRITHDACASGPCFNGATCYTGLSPNNFVCNCPYGFVGSRCEFPVGLPPSFPWVAVSLGVGLVVLLVLLVMVVVAVRQLRLRRPDDESREAMNNLSDFQKDNLIPAAQLKNTNQKKELEVDCGLDKSNCGKLQNHTLDYNLAPGLLGRGGMPGKYPHSDKSLGEKVPLRLHSEKPECRISAICSPRDSMYQSVCLISEERNECVIATEV

SEQ ID NO: 47 - DNA, 24 bp, Mus Musculus
ctccgggacgcaggcgtcatccct

SEQ ID NO: 48 - DNA, 29 bp, Mus Musculus
acaggcgctccgggacgcaggcgtcatcc

SEQ ID NO: 49 - DNA, 26 bp, Mus Musculus
ggtgtcctctccaccggacgcgtggg

SEQ ID NO: 50 - DNA, 22 bp, Mus Musculus
gtcctctccaccggacgcgtgg

SEQ ID NO: 51 - DNA, 20 bp, Homo Sapiens
gtttacattgcatcctggat

SEQ ID NO: 52 - protein, 28 aa, Artificial Sequence
  EGF-like domain consensus sequence
  VARIANT (2)...(5): Xaa = As few as 4 and up to 8 amino acids and the amino acid can be any amino acid
  VARIANT (7)...(7): Xaa = As few as 1 and up to 2 amino acids and the amino acid can be any amino acid
  VARIANT (9)...(9): Xaa = any amino acid
  VARIANT (11)...(15): Xaa = As few as 5 and up to 9 amino acids and the amino acid can be any amino acid
  VARIANT (16)...(16): Xaa = Trp, Phe or Tyr
  VARIANT (17)...(17): Xaa = any amino acid
  VARIANT (19)...(19): Xaa = any amino acid
  VARIANT (21)...(22): Xaa = As few as 2 and up to 4 amino acids and the amino acid can be any amino acid
  VARIANT (24)...(24): Xaa = Trp, Phe or Tyr
  VARIANT (26)...(26): Xaa = As few as 1 and up to 3 amino acids and the amino acid can be any amino acid
  VARIANT (27)...(27): Xaa = Phe or Tyr
CXXXXCXGXCXXXXXXXCXCXXGXGXXC

SEQ ID NO: 53 - DNA, 2133 bp, Homo Sapiens
  CDS (73)...(1275)
gtcgacccacgcgtccgccggagcgctcgcccagccgccgcctccaagcccctgaggtttccggggaccacaatgaacaagttgctgtgctgcgcgctcgtgtttctggacatctccattaagtggaccacccaggaaacgtttcctccaaagtaccttcattatgacgaagaaacttctcatcagctgttgtgtgacaaatgtcctcctggtacctacctaaaacaacactgtacagcaaagtggaagaccgtgtgcgccccttgccctgaccactactacacagacagctggcacaccagtgacgagtgtctatactgcagccccgtgtgcaaggagctgcagtacgtcaagcaggagtgcaatcgcacccacaaccgcgtgtgcgaatgcaaggaagggcgctaccttgagatagagttctgcttgaaacataggagctgccctcctggatttggagtggtgcaagctggaaccccagagcgaaatacagtttgcaaaagatgtccagatgggttcttctcaaatgagacgtcatctaaagcaccctgtagaaaacacacaaattgcagtgtctttggtctcctgctaactcagaaaggaaatgcaacacacgacaacatatgttccggaaacagtgaatcaactcaaaaatgtggaatagatgttaccctgtgtgaggaggcattcttcaggtttgctgttcctacaaagtttacgcctaactggcttagtgtcttggtagacaatttgcctggcaccaaagtaaacgcagagagtgtagagaggataaaacggcaacacagctcacaagaacagactttccagctgctgaagttatggaaacatcaaaacaaagaccaagatatagtcaagaagatcatccaagatattgacctctgtgaaaacagcgtgcagcggcacattggacatgctaacctcaccttcgagcagcttcgtagcttgatggaaagcttaccgggaaagaaagtgggagcagaagacattgaaaaaacaataaaggcatgcaaacccagtgaccagatcctgaagctgctcagtttgtggcgaataaaaaatggcgaccaagacaccttgaagggcctaatgcacgcactaaagcactcaaagacgtaccactttcccaaaactgtcactcagagtctaaagaagaccatcaggttccttcacagcttcacaatgtacaaattgtatcagaagttatttttagaaatgataggtaaccaggtccaatcagtaaaaataagctgcttataactggaaatggccattgagctgtttcctcacaattggcgagatccccatggatgagtaaactgtttctcaggcacttgaggctttcagtgatatctttctcattaccagtgactaattttgccacagggtactaaaagaaactatgatgtggagaaaggactaacatctcctccaataaaccccaaatggttaatccaactgtcagatctggatcgttatctactgactatattttcccttattactgcttgcagtaattcaactggaaattaaaaaaaaaaaactagactccattgtgccttactaaatatgggaatgtctaacttaaatagctttgagatttcagctaygctagaggcttttattagaaagccatatttttttctgtaaaagttactaatatatctgtaacactattacagtattgctatttatattcattcagatataagatttgtacatattatcatcctataaagaaacggtatgacttaattttagaaagaaaattatattctgtttattatgacaaatgaaagagaaaatatatatttttaatggaaagtttgtagcatttttctaataggtactgccatatttttctgtgtggagtatttttataattttatctgtataagctgtaatatcattttatagaaaatgcattatttagtcaattgtttaatgttggaaaacatatgaaatataaattatctgaatattagatgctctgagaaattgaatgtaccttatttaaaagattttatggttttataactatataaatgacattattaaagttttcaaattatttttaaaaaaaaaaaaaaaaaaaaaaaaaaaaagggcggccgc

SEQ ID NO: 54 - protein, 401 aa, Homo Sapiens
MNKLLCCALVFLDISIKWTTQETFPPKYLHYDEETSHQLLCDKCPPGTYLKQHCTAKWKTVCAPCPDHYYTDSWHTSDECLYCSPVCKELQYVKQECNRTHNRVCECKEGRYLEIEFCLKHRSCPPGFGVVQAGTPERNTVCKRCPDGFFSNETSSKAPCRKHTNCSVFGLLLTQKGNATHDNICSGNSESTQKCGIDVTLCEEAFFRFAVPTKFTPNWLSVLVDNLPGTKVNAESVERIKRQHSSQEQTFQLLKLWKHQNKDQDIVKKIIQDIDLCENSVQRHIGHANLTFEQLRSLMESLPGKKVGAEDIEKTIKACKPSDQILKLLSLWRIKNGDQDTLKGLMHALKHSKTYHFPKTVTQSLKKTIRFLHSFTMYKLYQKLFLEMIGNQVQSVKISCL

SEQ ID NO: 55 - DNA, 1203 bp, Homo Sapiens
atgaacaagttgctgtgctgcgcgctcgtgtttctggacatctccattaagtggaccacccaggaaacgtttcctccaaagtaccttcattatgacgaagaaacttctcatcagctgttgtgtgacaaatgtcctcctggtacctacctaaaacaacactgtacagcaaagtggaagaccgtgtgcgccccttgccctgaccactactacacagacagctggcacaccagtgacgagtgtctatactgcagccccgtgtgcaaggagctgcagtacgtcaagcaggagtgcaatcgcacccacaaccgcgtgtgcgaatgcaaggaagggcgctaccttgagatagagttctgcttgaaacataggagctgccctcctggatttggagtggtgcaagctggaaccccagagcgaaatacagtttgcaaaagatgtccagatgggttcttctcaaatgagacgtcatctaaagcaccctgtagaaaacacacaaattgcagtgtctttggtctcctgctaactcagaaaggaaatgcaacacacgacaacatatgttccggaaacagtgaatcaactcaaaaatgtggaatagatgttaccctgtgtgaggaggcattcttcaggtttgctgttcctacaaagtttacgcctaactggcttagtgtcttggtagacaatttgcctggcaccaaagtaaacgcagagagtgtagagaggataaaacggcaacacagctcacaagaacagactttccagctgctgaagttatggaaacatcaaaacaaagaccaagatatagtcaagaagatcatccaagatattgacctctgtgaaaacagcgtgcagcggcacattggacatgctaacctcaccttcgagcagcttcgtagcttgatggaaagcttaccgggaaagaaagtgggagcagaagacattgaaaaaacaataaaggcatgcaaacccagtgaccagatcctgaagctgctcagtttgtggcgaataaaaaatggcgaccaagacaccttgaagggcctaatgcacgcactaaagcactcaaagacgtaccactttcccaaaactgtcactcagagtctaaagaagaccatcaggttccttcacagcttcacaatgtacaaattgtatcagaagttatttttagaaatgataggtaaccaggtccaatcagtaaaaataagctgctta

SEQ ID NO: 56 - DNA, 4291 bp, Homo Sapiens
  CDS (958)...(3216)
gtcgacccacgcgtccgaggagctggggtgagccgcggcggccgtctctcccacccgcagcagcatcctctctgcccttctctgccaccccggggagagccgggagctgcctctttacagcttccacgagccaggggtgcaggcagctgcccccaggaagtttgggcttctgcgtagtttaggggtgcctgcgagcgccccagagggcgaggggccgagggcgatgttgggcgccgcgcggggctgggggcgcccagaagacgtgcgagtgtccgcggtcctgctgctgtctccagtaccctccgcatcccccaagtgatgggaacaagggcccgcccaggcagccgctgtcgccgcaccgccccctcgctcgctctctgcgcgcggagtcacccagtcacactcccggcaccccgagcccttcctccggagctgctgcttctactttggctgctatcgccgccgccgcgggtggcccgctgctgactgggctcgccgggagacggagaagcactttttggccctccctcagcagctctcacaccccaactttgccgccgccgccgcgcctgccctcgcagcggcgctcggccgcacattgtgagggcgcacgccgggaggctccgcaagaccgtggaggcaggaaacggcactactgcgcttctgcctcggctctttgttgttcgctttggatggttcttgaaagtgtctgagcctcctcggaaatcctggggccggagaagacaaaccttggaattcttcctctgcaaaagtctctgagatactgacaagcgtccggaaaggtcgacgagtaattgccctgaaaactcttggctaattgacccacgttgcttatattaagcctttgtgtgtggtgtgtggcttcatacatttggggaccctatttccactccctcctcttggcatgagactgtatacaggatccacccgaggacaatgattgcggagcccgctcacttttacctgtttggattaatatgtctctgttcaggctcccgtcttcgtcaggaagattttccacctcgcattgttgaacacccttcagacctgattgtctcaaaaggagaacctgcaactttgaactgcaaagctgaaggccgccccacacccactattgaatggtacaaagggggagagagagtggagacagacaaagatgaccctcgctcacaccgaatgttgctgccgagtggatctttatttttcttacgtatagtacatggacggaaaagtagacctgatgaaggagtctatgtctgtgtagcaaggaattaccttggagaggctgtgagccacaatgcatcgctggaagtagccatacttcgggatgacttcagacaaaacccttcggatgtcatggttgcagtaggagagcctgcagtaatggaatgccaacctccacgaggccatcctgagcccaccatttcatggaagaaagatggctctccactggatgataaagatgaaagaataactatacgaggaggaaagctcatgatcacttacacccgtaaaagtgacgctggcaaatatgtttgtgttggtaccaatatggttggggaacgtgagagtgaagtagccgagctgactgtcttagagagaccatcatttgtgaagagacccagtaacttggcagtaactgtggatgacagtgcagaatttaaatgtgaggcccgaggtgaccctgtacctacagtacgatggaggaaagatgatggagagctgcccaaatccagatatgaaatccgagatgatcataccttgaaaattaggaaggtgacagctggtgacatgggttcatacacttgtgttgcagaaaatatggtgggcaaagctgaagcatctgctactctgactgttcaagttgggtctgaacctccacattttgttgtgaaaccccgtgaccaggttgttgctttgggacggactgtaacttttcagtgtgaagcaaccggaaatcctcaaccagctattttctggaggagagaagggagtcagaatctacttttctcatatcaaccaccacagtcatccagccgattttcagtctcccagactggcgacctcacaattactaatgtccagcgatctgatgttggttattacatctgccagactttaaatgttgctggaagcatcatcacaaaggcatatttggaagttacagatgtgattgcagatcggcctcccccagttattcgacaaggtcctgtgaatcagactgtagccgtggatggcactttcgtcctcagctgtgtggccacaggcagtccagtgcccaccattctgtggagaaaggatggagtcctcgtttcaacccaagactctcgaatcaaacagttggagaatggagtactgcagatccgatatgctaagctgggtgatactggtcggtacacctgcattgcatcaacccccagtggtgaagcaacatggagtgcttacattgaagttcaagaatttggagttccagttcagcctccaagacctactgacccaaatttaatccctagtgccccatcaaaacctgaagtgacagatgtcagcagaaatacagtcacattatcatggcaaccaaatttgaattcaggagcaactccaacatcttatattatagaagccttcagccatgcatctggtagcagctggcagaccgtagcagagaatgtgaaaacagaaacatctgccattaaaggactcaaacctaatgcaatttaccttttccttgtgagggcagctaatgcatatggaattagtgatccaagccaaatatcagatccagtgaaaacacaagatgtcctaccaacaagtcagggggtggaccacaagcaggtccagagagagctgggaaatgctgttctgcacctccacaaccccaccgtcctttcttcctcttccatcgaagtgcactggacagtagatcaacagtctcagtatatacaaggatataaaattctctatcggccatctggagccaaccacggagaatcagactggttagtttttgaagtgaggacgccagccaaaaacagtgtggtaatccctgatctcagaaagggagtcaactatgaaattaaggctcgccctttttttaatgaatttcaaggagcagatagtgaaatcaagtttgccaaaaccctggaagaaggcaagtatgatgaagcgtttgatttccatgcattgcagtatatttgttagaattttattagcttaatttaaattgttataatgttaatagtggcattaattactaactttcttgatattgaacatacattttgctaacagtatttgtttatttagaaaactagaaaagcaaaatgctataatagttgacttgcttcaatagtggcctacctcaaatgtgtaaatgtgaacattatattacttaatggcatatagaaatttaattattcagaactaaaattcacatttaaaaatgaaattgttttccgtttggtttattttccattcagcattttctatttgtttattttgatccatgatttgaataatgtgttgatttgcccaggacttcgtgggattagcattttcttcctaaatctcatctcttttaaaacacctcagttctagacaaatcactatagctgaccaccctattcctagaaattaaacaatatttacataaaggtaaaagattacattaactaacaacaggatttttcccaacatgtctttgtcactttggctgtataagtaattatcatgaatgattaatattcattttcatacttttgaacatttcgggggagaacatgagactagagttacacggtagaagaaataggaattgtcctgggatgtttggtggaaacaaggtatttaactttggttatggaaaattcaccgtggcagtgaattagcattgagtgaggaacaacttaggtagtttgggactattcagacttggatgagatacatctttaaaacatatgcagctgggcacagtggctcacgcctgtaaccccagcactttaggaggctgaggcgggcggatcacctgaagtcacgagttcgagaccagcctggccaaggcggtgaaaccccatctctattaaaaatacaaaaattagtggggcatggtggtgggtgcctgtaatcccagctactcagggggctgaggcaggagaatcgcttgaacccgggagggggaggttgcagtgagccgagatcatgtcacagcactacagcctagatgacagagcgagcctccgtctcaaaaaaaaaaaaaaaaaaaaagggcggccgc

SEQ ID NO: 57 - protein, 753 aa, Homo Sapiens [sequence omitted]

SEQ ID NO: 58 - DNA, 2259 bp, Homo Sapiens
atgattgcggagcccgctcacttttacctgtttggattaatatgtctctgttcaggctcccgtcttcgtcaggaagattttccacctcgcattgttgaacacccttcagacctgattgtctcaaaaggagaacctgcaactttgaactgcaaagctgaaggccgccccacacccactattgaatggtacaaagggggagagagagtggagacagacaaagatgaccctcgctcacaccgaatgttgctgccgagtggatctttatttttcttacgtatagtacatggacggaaaagtagacctgatgaaggagtctatgtctgtgtagcaaggaattaccttggagaggctgtgagccacaatgcatcgctggaagtagccatacttcgggatgacttcagacaaaacccttcggatgtcatggttgcagtaggagagcctgcagtaatggaatgccaacctccacgaggccatcctgagcccaccatttcatggaagaaagatggctctccactggatgataaagatgaaagaataactatacgaggaggaaagctcatgatcacttacacccgtaaaagtgacgctggcaaatatgtttgtgttggtaccaatatggttggggaacgtgagagtgaagtagccgagctgactgtcttagagagaccatcatttgtgaagagacccagtaacttggcagtaactgtggatgacagtgcagaatttaaatgtgaggcccgaggtgaccctgtacctacagtacgatggaggaaagatgatggagagctgcccaaatccagatatgaaatccgagatgatcataccttgaaaattaggaaggtgacagctggtgacatgggttcatacacttgtgttgcagaaaatatggtgggcaaagctgaagcatctgctactctgactgttcaagttgggtctgaacctccacattttgttgtgaaaccccgtgaccaggttgttgctttgggacggactgtaacttttcagtgtgaagcaaccggaaatcctcaaccagctattttctggaggagagaagggagtcagaatctacttttctcatatcaaccaccacagtcatccagccgattttcagtctcccagactggcgacctcacaattactaatgtccagcgatctgatgttggttattacatctgccagactttaaatgttgctggaagcatcatcacaaaggcatatttggaagttacagatgtgattgcagatcggcctcccccagttattcgacaaggtcctgtgaatcagactgtagccgtggatggcactttcgtcctcagctgtgtggccacaggcagtccagtgcccaccattctgtggagaaaggatggagtcctcgtttcaacccaagactctcgaatcaaacagttggagaatggagtactgcagatccgatatgctaagctgggtgatactggtcggtacacctgcattgcatcaacccccagtggtgaagcaacatggagtgcttacattgaagttcaagaatttggagttccagttcagcctccaagacctactgacccaaatttaatccctagtgccccatcaaaacctgaagtgacagatgtcagcagaaatacagtcacattatcatggcaaccaaatttgaattcaggagcaactccaacatcttatattatagaagccttcagccatgcatctggtagcagctggcagaccgtagcagagaatgtgaaaacagaaacatctgccattaaaggactcaaacctaatgcaatttaccttttccttgtgagggcagctaatgcatatggaattagtgatccaagccaaatatcagatccagtgaaaacacaagatgtcctaccaacaagtcagggggtggaccacaagcaggtccagagagagctgggaaatgctgttctgcacctccacaaccccaccgtcctttcttcctcttccatcgaagtgcactggacagtagatcaacagtctcagtatatacaaggatataaaattctctatcggccatctggagccaaccacggagaatcagactggttagtttttgaagtgaggacgccagccaaaaacagtgtggtaatccctgatctcagaaagggagtcaactatgaaattaaggctcgccctttttttaatgaatttcaaggagcagatagtgaaatcaagtttgccaaaaccctggaagaaggcaagtatgatgaagcgtttgatttccatgcattgcagtatatttgt

SEQ ID NO: 59 - protein, 85 aa, Homo Sapiens
PSAPSKPEVTDVSRNTVLSWQPNLNSGATPTSYIIEAFSHASGSSWQTVAENVKTETSAIKGLKPNAIYLFLVRAANAYGISDPS

SEQ ID NO: 60 - protein, 90 aa, Homo Sapiens
GNAVLHLHNPTVLSSSSIEVHWTVDQQSQYIQGYKILYRPSGANHGESDWLVFEVRTPAKNSVVIPDLRKGVNYEIKARPFFNEFQGADS

SEQ ID NO: 61 - protein, 68 aa, Homo Sapiens
GEPATLNCKAEGRPTPTIEWYKGGERVETDKDDPRSHRMLLPSGSLFFLRIVHGRKSRPDEGVYVCVA

SEQ ID NO: 62 - protein, 59 aa, Homo Sapiens
GEPAVMECQPPRGHPEPTISWKKDGSPLDDKDERITIRGGKLMITYTRKSDAGKYVCVG

SEQ ID NO: 63 - protein, 57 aa, Homo Sapiens
DDSAEFKCEARGDPVPTVRWRKDDGELPKSRYEIRDDHTLKIRKVTAGDMGSYTCVA

SEQ ID NO: 64 - protein, 66 aa, Homo Sapiens
GRTVTFQCEATGNPQPAIFWRREGSQNLLFSYQPPQSSSRFSVSQTGDLTITNVQRSDVGYYICQT

SEQ ID NO: 65 - protein, 59 aa, Homo Sapiens
DGTFVLSCVATGSPVPTILWRKDGVLVSTQDSRIKQLENGVLQIRYAKLGDTGRYTCVA

SEQ ID NO: 66 - DNA, 2122 bp, Homo Sapiens
  CDS (1)...(1047)
ccacgcgtccgccggagcgctcgcccagccgccgcctccaagcccctgaggtttccggggaccacaatgaacaagttgctgtgctgcgcgctcgtgtttctggacatctccattaagtggaccacccaggaaacgtttcctccaaagtaccttcattatgacgaagaaacctctcatcagctgttgtgtgacaaatgtcctcctggtacctacctaaaacaacactgtacagcaaagtggaagaccgtgtgcgccccttgccctgaccactactacacagacagctggcacaccagtgacgagtgtctatactgcagccccgtgtgcaaggagctgcagtacgtcaagcaggagtgcaatcgcacccacaaccgcgtgtgcgaatgcaaggaagggcgctaccttgagatagagttctgcttgaaacataggagctgccctcctggatttggagtggtgcaagctggaaccccagagcgaaatacagtttgcaaaagatgtccagatgggttcttctcaaatgagacgtcatctaaagcaccctgtagaaaacacacaaattgcagtgtctttggtctcctgctaactcagaaaggaaatgcaacacacgacaacatatgttccggaaacagtgaatcaactcaaaaatgtggaatagatgttaccctgtgtgaggaggcattcttcaggtttgctgttcctacaaagtttacgcctaactggcttagtgtcttggtagacaatttgcctggcaccaaagtaaacgcagagagtgtagagaggataaaacggcaacacagctcacaagaacagactttccagctgctgaagttatggaaacatcaaaacaaagaccaagatatagtccagaagatcatccaagatattgacctctgtgaaaacagcgtgcagcggcacattggacatgctaacctcaccttcgagcagcttcgtagcttgatggaaagcttaccggggaaagaaagtgggagcaggaaggacattggaaaaaacaataaaggcatgcaaacccagtggaccagatcctgaagctgctcagtttgtggcgaataaaaaatggcgaccaagacaccttgaagggcctaatgcacgcactaaagcactcaaagacgtaccactttcccaaaactgtcactcagagtctaaagaagaccatcaggttccttcacagcttcacaatgtacaaattgtatcagaagttatttttagaaatgataggtaaccaggtccaatcagtaaaaataagctgcttataactggaaatggccattgagctgtttcctcacaattggcgagatccccatggatgagtaaactgtttctcaggcacttgaggctttcagtgatatctttctcattaccagtgactaattttgccacagggtactaaaagaaactatgatgtggagaaaggactaacatctcctccaataaaccccaaatggttaatccaactgtcagatctggatcgttatctactgactatattttcccttattactgcttgcagtaattcaactggaaattaaaaaaaaaaaactagactccattgtgccttactaaatatgggaatgtctaacttaaatagctttgagatttcagctatgctagaggcttttattagaaagccatatttttttctgtaaaagttactaatatatctgtaacactattacagtattgctatttatattcattcagatataagatttgtacatattatcatcctataaagaaacggtatgacttaattttagaaagaaaattatattctgtttattatgacaaatgaaagagaaaatatatatttttaatggaaagtttgtagcatttttctaataggtactgccatatttttctgtgtggagtatttttataattttatctgtataagctgtaatatcattttatagaaaatgcattatttagtcaattgtttaatgttggaaaacatatgaaatataaattatctgaatattagatgctctgagaaattgaatgtaccttatttaaaagattttatggttttataactatataaatgacattattaaagttttcaaattatttttaaaaaaaaaaaaaaaaaaaaaaaaaaaaa

SEQ ID NO: 67 - protein, 349 aa, Homo Sapiens
PRVRRSARPAAASKPLRFPGTTMNKLLCCALVFLDISIKWTTQETFPPKYLHYDEETSHQLLCDKCPPGTYLKQHCTAKWKTVCAPCPDHYYTDSWHTSDECLYCSPVCKELQYVKQECNRTHNRVCECKEGRYLEIEFCLKHRSCPPGFGVVQAGTPERNTVCKRCPDGFFSNETSSKAPCRKHTNCSVFGLLLTQKGNATHDNICSGNSESTQKCGIDVTLCEEAFFRFAVPTKFTPNWLSVLVDNLPGTKVNAESVERIKRQHSSQEQTFQLLKLWKHQNKDQDIVQKIIQDIDLCENSVQRHIGHANLTFEQLRSLMESLPGKESGSRKDIGKNNKGMQTQWTRS

SEQ ID NO: 68 - protein, 84 aa, Homo Sapiens
PSPPRNLRVTDITPTSITVSWTPPEGNGPITGYRIQYRWPVNDNEWNEFNVPRTTNSYTITNLRPGTEYEFRVQAVNGDGGPWS

SEQ ID NO: 69 - protein, 47 aa, Homo Sapiens
GQSVTLTCMVSFHPQDYTIWWYRNGGPITLTINSWQVEDSGTYWCMV

SEQ ID NO: 70 - protein, 1650 aa, Homo Sapiens
MKWKHVPFLVMISLLSLSPNHLFLAQLIPDPEDVERGNDHGTPIPTSDNDDNSLGYTGSRLRQEDFPPRIVEHPSDLIVSKGEPATLNCKAEGRPTPTIEWYKGGERVETDKDDPRSHRMLLPSGSLFFLRIVHGRKSRPDEGVYVCVARNYLGEAVSHNASLEVAILRDDFRQNPSDVMVAVGEPAVMECQPPRGHPEPTISWKKDGSPLDDKDERITIRGGKLMITYTRKSDAGKYVCVGTNMVGERESEVAELTVLERPSFVKRPSNLAVTDDSAEFKCEARGDPVPTVRWRKDDGELPKSRYEIRDDHTLKIRKVTAGDMGSYTCVAENMVGKAEASATLTVQEPPHFVVKPRDQVVALGRTVTFQCEATGNPQPAIFWRREGSQNLLFSYQPPQSSSRFSVSQTGDLTITNVQRSDVGYYICQTLNVAGSIITKAYLEVTDVIADRPPPVIRQGPVNQTVAVDGTFVLSCVATGSPVPTILWRKDGVLVSTQDSRIKQLENGVLQIRYAKLGDTGRYTCIASTPSGEATWSAYIEVQEFGVPVQPPRPTDPNLIPSAPSKPEVTDVSRNTVTLSWQPNLNSGATPTSYIIEAFSHASGSSWQTVAENVKTETSAIKGLKPNAIYLFLVRAANAYGISDPSQISDPVKTQDVLPTSQGVDHKQVQRELGNAVLHLHNPTVLSSSSIEVHWTVDQQSQYIQGYKILYRPSGANHGESDWLVFEVRTPAKNSVVIPDLRKGVNYEIKARPFFNEFQGADSEIKFAKTLEEAPSAPPQGVTVSKNDGNGTAILVSWQPPPEDTQNGMVQEYKVWCLGNETRYHINKTVDGSTFSVVIPFLVPGIRYSVEVAASTGAGSGVKSEPQFIQLDAHGNPVSPEDQVSLAQQISDVVKQPAFIAGIGAACWIILMVFSIWLYRHRKKRNGLTSTYAGIRKVPSFTFTPTVTYERGGEAVSSGGRPGLLNISEPAAQPWLADTWPNTGNNHNDCSISCCTAGNGNSDSNLTTYSRPADCIANYNNQLDNKQTNLMLPESTVYGDVDLSNKINEMKTFNSPNLKDGRFVNPSGQPTPYATTQLIQSNLSNNMNNGSGDSGEKHWKPLGQQKQEVAPVQYNIVEQNKLNKDYRANDTVPPTIPYNQSYDQNTGGSYNSSDRGSSTSGSQGHKKGARTPKVPKQGGMNWADLLPPPPAHPPPHSNSEEYNISVDESYDQEMPCPVPPARMYLQQDELEEEEDERGPTPPVRGAASSPAAVSYSHQSTATLTPSPQEELQPMLQDCPEETGHMQHQPDRRRQPVSPPPPPRPISPPHTYGYISGPLVSDMDTDAPEEEEDEADMEVAKMQTRRLLLRGLEQTPASSVGDLESSVTGSMINGWGSASEEDNISSGRSSVSSSDGSFFTDADFAQAVAAAAEYAGLKVARRQMQDAAGRRHFHASQCPRPTSPVSTDSNMSAAVMQKTRPAKKLKHQPGHLRRETYTDDLPPPPVPPPAIKSPTAQSKTQLEVRPVVVPKLPSMDARTDRSSDRKGSSYKGREVLDGRQVVDMRTNPGDPREAQEQQNDGKGRGNKAAKRDLPPAKTHLIQEDILPYCRPTFPTSNNPRDPSSSSSMSSRGSGSRQREQANVGRRNIAEMQVLGGYERGEDNNEELEETES

SEQ ID NO: 71 - DNA, 989 bp, Homo Sapiens
  CDS (356)...(889)
gtcgacccacgcgtccgcagacgtctacctgggggtcccgtctgcgctcccgggatggaaaacgcccaggggaaacttaggcaggcgagcggacgggcacctcccgcgggacgaactcactcggtggcctcctacttccccggccgtgttccaacgcctgagaataacgggaacagcggtcgtactcaccgacagcggcagcagcggcctctctcaattgggcaaagcactccagaccttttggaagagtgacaccaaaggcaagcacctgcttggcaggcccctcagcttctacgcaagtataagtcttggacttcattccattttctgttgagtaataaactcaacgttgaaaatgtcctttgtgggggagaactcaggagtgaaaatgggctctgaggactgggaaaaagatgaaccccagtgctgcttagaagacccggctggaagccccctggaaccaggcccaagcctccccaccatgaattttgttcacacaaagatcttctttgcattagcctcatccttgagctcagcctctgcggagaaaggaagtccgattctcctgggggtctctaaaggggagttttgtctctactgtgacaaggataaaggacaaagtcatccatcccttcagctgaagaaggagaaactgatgaagctggctgcccaaaaggaatcagcacgccggcccttcatcttttatagggctcaggtgggctcctggaacatgctggagtcggcggctcaccccggatggttcatctgcacctcctgcaattgtaatgagcctgttggggtgacagataaatttgagaacaggaaacacattgaattttcatttcaaccagtttgcaaagctgaaatgagccccagtgaggtcagcgattaggaaactgccccattgaacgccttcctcgctaatttgaactaattgtataaaaacaccaaacctgctcactaaaaaaaaaaaaaaaaagggcggccgc

SEQ ID NO: 72 - protein, 178 aa, Homo Sapiens
MSFVGENSGVKMGSEDWEKDEPQCCLEDPAGSPLEPGPSLPTMNFVHTKIFFALASSLSSASAEKGSPILLGVSKGEFCLYCDKDKGQSHPSLQLKKEKLMKLAAQKESARRPFIFYRAQVGSWNMLESAAHPGWFICTSCNCNEPVGVTDKFENRKHIEFSFQPVCKAEMSPSEVSD

SEQ ID NO: 73 - DNA, 534 bp, Homo Sapiens
atgtcctttgtgggggagaactcaggagtgaaaatgggctctgaggactgggaaaaagatgaaccccagtgctgcttagaagacccggctggaagccccctggaaccaggcccaagcctccccaccatgaattttgttcacacaaagatcttctttgcattagcctcatccttgagctcagcctctgcggagaaaggaagtccgattctcctgggggtctctaaaggggagttttgtctctactgtgacaaggataaaggacaaagtcatccatcccttcagctgaagaaggagaaactgatgaagctggctgcccaaaaggaatcagcacgccggcccttcatcttttatagggctcaggtgggctcctggaacatgctggagtcggcggctcaccccggatggttcatctgcacctcctgcaattgtaatgagcctgttggggtgacagataaatttgagaacaggaaacacattgaattttcatttcaaccagtttgcaaagctgaaatgagccccagtgaggtcagcgat

SEQ ID NO: 74 - protein, 63 aa, Homo Sapiens
MSFVGENSGVKMGSEDWEKDEPQCCLEDPAGSPLEPGPSLPTMNFVHTKIFFALASSLSSASA

SEQ ID NO: 75 - protein, 115 aa, Homo Sapiens
EKGSPILLGVSKGEFCLYCDKDKGQSHPSLQLKKEKLMKLAAQKESARRPFIFYRAQVGSWNMLESAAHPGWFICTSCNCNEPVGVTDKFENRKHIEFSFQPVCKAEMSPSEVSD

SEQ ID NO: 76 - DNA, 501 bp, Homo Sapiens
  CDS (1)...(501)
atgggctctgaggactgggaaaaagatgaaccccagtgctgcttagaagacccggctggaagccccctggaaccaggcccaagcctccccaccatgaattttgttcacacaaagatcttctttgcattagcctcatccttgagctcagcctctgcggagaaaggaagtccgattctcctgggggtctctaaaggggagttttgtctctactgtgacaaggataaaggacaaagtcatccatcccttcagctgaagaaggagaaactgatgaagctggctgcccaaaaggaatcagcacgccggcccttcatcttttatagggctcaggtgggctcctggaacatgctggagtcggcggctcaccccggatggttcatctgcacctcctgcaattgtaatgagcctgttggggtgacagataaatttgagaacaggaaacacattgaattttcatttcaaccagtttgcaaagctgaaatgagccccagtgaggtcagcgat

SEQ ID NO: 77 - protein, 167 aa, Homo Sapiens
MGSEDWEKDEPQCCLEDPAGSPLEPGPSLPTMNFVHTKIFFALASSLSSASAEKGSPILLGVSKGEFCLYCDKDKGQSHPSLQLKKEKLMKLAAQKESARRPFIFYRAQVGSWNMLESAAHPGWFICTSCNCNEPVGVTDKFENRKHIEFSFQPVCKAEMSPSEVSD

SEQ ID NO: 78 - protein, 52 aa, Homo Sapiens
MGSEDWEKDEPQCCLEDPAGSPLEPGPSLPTMNFVHTKIFFALASSLSSASA

SEQ ID NO: 79 - protein, 115 aa, Homo Sapiens; identical to SEQ ID NO: 75

SEQ ID NO: 80 - DNA, 408 bp, Homo Sapiens
  CDS (1)...(408)
atgaattttgttcacacaaagatcttctttgcattagcctcatccttgagctcagcctctgcggagaaaggaagtccgattctcctgggggtctctaaaggggagttttgtctctactgtgacaaggataaaggacaaagtcatccatcccttcagctgaagaaggagaaactgatgaagctggctgcccaaaaggaatcagcacgccggcccttcatcttttatagggctcaggtgggctcctggaacatgctggagtcggcggctcaccccggatggttcatctgcacctcctgcaattgtaatgagcctgttggggtgacagataaatttgagaacaggaaacacattgaattttcatttcaaccagtttgcaaagctgaaatgagccccagtgaggtcagcgat

SEQ ID NO: 81 - protein, 136 aa, Homo Sapiens
MNFVHTKIFFALASSLSSASAEKGSPILLGVSKGEFCLYCDKDKGQSHPSLQLKKEKLMKLAAQKESARRPFIFYRAQVGSWNMLESAAHPGWFICTSCNCNEPVGVTDKFENRKHIEFSFQPVCKAEMSPSEVSD

SEQ ID NO: 82 - protein, 21 aa, Homo Sapiens
MNFVHTKIFFALASSLSSASA

SEQ ID NO: 83 - protein, 115 aa, Homo Sapiens; identical to SEQ ID NO: 75

SEQ ID NO: 84 - protein, 177 aa, Homo Sapiens
MEICRGLRSHLITLLLFLFHSETICRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 85 - protein, 153 aa, Homo Sapiens
APVRSLNCTLRDSQQKSLVMSGPYELKALHLQGQDMEQQVVFSMSFVQGEESNDKIPVALGLKEKNLYLSCVLKDDKPTLQLESVDPKNYPKKKMEKRFVFNKIEINNKLEFESAQFPNWYISTSQAENMPVFLGGTKGGQDITDFTMQFVSS

SEQ ID NO: 86 - DNA, 152331 bp, Homo Sapiens
  misc_feature (1)...(152331): n = A,T,C or G
gaagtgaagatataatgtatagtagtaatatataatgttaggtgaattaaaggaaatagaatatattggggagtaattatgggtgtaaagaaatatagtagggaagtatttagatttgagaaaaaaaaaaaggaatttagtgtaggtgaanaataaaagnanaaggttaaaaattaaaaaaaaattaaatataaataaataaataaaaataaaaataaaataaaaaatttaaaaaattaaaaaaatataaaaaataaagaaatggaagtggattcttagaaaaaaaagaaagtaaggtgatatgaggagatagagaggatgtggtgtgagatgattggtttaattagaaaataggttttgaatagagtgggaaagtagagttttggtaaatgtggggggaagagggtaatgttgtttgagtgaaagaaaaaatggtatatttttataaaataatgaggaaagtgtgtgaaaaaaaaattattgggatttgggaaggtgatatataaagttgtggaaaatttggggggtggggtttatttaggattaaaaagttatttaaagaatgaaaatgaatttttgtttgtaatttggggataagaaattaatgtttagaaagaaagggaaaaaattgaagaaaaaaatttagattttggaaatttaaaaatattgtgggtgtaaataggaaggatttttaaaggtaattgtggaagggatttgtgtggaaaataatagggagaaaaaatgggggcatctaactggagcctgcattattacagatttagcatcaccaaagtctaaacaattagactgactaaggcagaactgcccttatgacagcagacataagaaggaaaaggccaaaacactgtgttaaaaattatccaaatgtgaggaaaaggcaaagagagtaggtgtgcctttttagtgtctaagctgcctgcccaaggggcatctgatgctctcaggcaggagtccacaaatttttttttgtaaaagatcagatagtaaatcttttcagcgtgaagagcatgaggtctctgtcacaaatactcaaccaccattacaacatgaaagcagccaacagacaacacatgacaaatgagtgtggctgtgttccagtaaatcttgattacaaaaacaggcaagaggccagagctgacccatgggccatagtttgctgaccccttctgtaaaggaaagtatttttgtttgacttgctgtttaccattgattgaacacaaggctctgtaaagttacttgttaacttgcagaagattgatgagtggcaagtaatttttattcaccagaatataaaattatttctgttcagtagaaaagataaaccaactgtgatattatggtcctgggggtgtctgtctaccatgtgctcgcagttctgtaataaatgttctctcaagatccttaaaatctcttggaaattataaaaatattggaaagagaagaacagtttttaaaatatatatatatatatatattttttttgagatggagtcttgctctgtcgtccaggctggagtgcagtggcgcaaacttggttcaccacaacctctgcctcccgggttcaagcgattcttctgcctcagcctcctgagtagctgggactacaggcgcccgccaccacgcccagctaatttttgtatttttagtagagacgaggttttactatgttggctaggctggtctcaaactcctgaccttgtgatctgcccgccttggcctcccaaagtgctgggattacaggtgtgagccactgcacctggccagttttttaaatatatttttaaaaacacttgaataagagtcagtgtaaactagaagtttaaaaatgcttcacagaacacccagggtttacattacaagattctcacaacaaacctattgtaaaggtgagtaaggcatgttattacagagaaaagtttgggagcaaaactgtaaaaaattatatttttgttgtattttctaagagaaagagtattgttatgttctcctaacctctgttgattactactttaagtgatttccttgagagcacatgatgatccgccgttcatagaaaactgaaagcaataagatgactaggtaagcatgacatttaaaaggtattcatgggacgtggttacaaaaccaactcacaactaaaaagtcttaggacctctcgctgacttaggagcctgatcccaactctgagaatgactcagtgtgttaccctgtggctagtgtagaccaatgatcctgtctcagagtcactagccaacagcccatatcaagtacttgaaactttgactcagaaacctcagtgtcagaacctttgacctaggaaccacctgtagtggttaactgcaatttgcaccccttagttcagggctttacaacaccgggggcggggaggggaaaggcatananctgatgacctaaaggaaacccattgcagcaacgcttttgtgttaagtgtacaaataagtgttgttttagaatcctccaggtaatgcctttgttatttaatgtgtctgagacaattctgcacattaaagaatataaaatattaccttgtaattccaatttgaaatgtgtaattgacattagacttctatttgaatttgaaatgtctaaaacaatgtggttaagtttgtaaaaggtgtgtgaattttgagtctgatttactacatttttttttaattttctttttttttggagttttagggattgcttagatggctagaaagattttattcatcagatttttaagtctgccttggcaggcacttgcagtgtttgaaagaatcagatatatcaaatttgtagtttaaaatatttaagggaactcaattaactatgctagaaaagagaattaagtatttaggaggatttaatatggtgtgaaagttgtgaaaatcaaaatggagacactaatgttaagaaaaccctgataaatggaaccagggaaaggcatgaagatagagttctcacacttgtatccctgatcatgaaaaagatctgcgggtttttccgcgtttttacccgaaatcttcaagggatgggaaaaagaaaattgctaaaaaatctcggttttttggttttaacagatatttacaccntggatcccatttattatgttgtccccaaggttttcggtgggttcccaatcagttagcccccctccacagtgaaagcactttactttatcaccttcacctaaagcataaaatccagctcttgaaagctgctccttgttaactgaatatatccacatcccaaaagtaatgatccatgcttcataatctgccacggatggatggatggatggatggatggatggatggatggatgaatggatggattgatttcttggaggatttgttgaatttgggaaattccacgccaggacagctggcccaaactgcccgcgacaatctgctcggtacaaggggagggtcctggagagggtgcggcccgagccccagtttggaaatgccaacttggctctgcagccgggccttagccacttgggtctggcgtccctccattattagcgccatgccggctcggggtgctgccaagtccctgagagcacaagcccgcgctcaagaaaagctgaagtgtgaatgttctgtctaccttcacagtaaatgctaagagaatgacccaagagcagagggtatcactctgctacggaggattgattgtaactggctctcctgccttagcaagaaatgccagaaccatggtcattcaagttcttgaccaaaaactgccttcatgagaatcaacttccccaagaaaaaaaaagcagaaacaggcaaagcttccagcatggtaggtaatactgacccttcttccctccttcctttggagattcacacagtaataatgcataaagctttgccaatggactaagcactgcccaggggtttttgtcatgcctggactgaaatgctctttttgcgttatcatagaatcccagtgcagtctgagtagactctaagcaaaagggacatttttcaaaaaggctttaaattgctagtacaaagaaggcaacaaaacttgcgtaactgtggacagattaactcacttggtgttttggctcttcagttttcccttggctgcgaagtactcctgaagctttctctgcggctcttcctgcaagcaggcaagcaaaaaaacgactgaactttatttcgagatgaagagccgctaacttgctgtagtgataaggaatgaactaaggctagggacatattaacatccgctggtggtgactctttagcctagatcttaccccactcctgctccttccatatggttcggtctcaggctcactaccgatcaatggcgtactaaaagcactaactatagactccaacacgtctgtcgtgtgtttcacgacaagccgtggagttaatccctctgacagtagctcagataaggatgggctatcatgggcccggaactggggcatgacgctcgtcaccaacgcatgagctccccaagtatgctatacctgtccctatgaagggcttccaactctatgtgcagtccccatgtggagagtcaggtattgattgatcaagccaggggtgtggtgaatggggagcttcctacaggggtaatgataattgaaatgcacggtgatggggattttcatattggtctcctaaggagataacagattggatgcggggtcgatattccactgcccagggtgtgtaccgagggtatctgcaggtggatctcctccccacgtttgattaatactcctgtcttgggaagcatagacgggcgggggaaatgatgaagggtgaccactccccgggaacgcagtgctctgtacgatggccttgattgcgaattcctgcagggggggggcaagagatttaatattcattccatcttcatttggaagatgaaaaattggggaccagagaggggaggggactgggccaagttttcaaagaaaagtcagtaggaattgtgaattcctgggggccggggcccattagtgctgttttggatcagtaaatggagatgtgagtttcaacagtaacagggacattttaaaattaaaatgatttaacctttagaaaatgtcctattttgtaataatgatggattcacaggaaggtacaaagaaatgtccagagagttcntgagcccccttcagccagcttcttccaatgttaacatcttgcattattatagtacaacatcaaaactgggaaatcgatattggtactgtccagatagcttactcagattttgccagttatacttccactcatttgtgtgtgtgtgtgtgtgtgtgtgtgtgtgtgtgtgtgtgtagctctatgcaattttatgtgtgtagcttcatgtaaccaccacaatcacaatacttaactatgccctcatcacaagactctctcttgctatgctttacagctgtatcctcttcatctccaaaccctaagcccacctcaccgcctccaccatctctaatccctggcaaccactattctgtgctccatctctgtaattaattgtgttaattaatgttatacaaatggaatcatgaagtatgtgtcctttgagattgggctgttaatttttcactcagcacaatttccgtgagtctaatccaacttgtgtgtagcagtaattctttccttattattgctgaataatatgccatggtatggatgtatcacagtgtgtctaatcctttgcccattgaaaggaatttggataatttccaggttttggctattatgaataaagtgaacataagacatgtgtgtacaaattttggtgtgatcaaaagtctcatttctctgggataaatgcccggtaatgaaatggctgggttgtgtggggcaagaacacaggcgcgtattataaccttactaccaagacctgaacccatataaaggtttatgcgtaacaatcatcatccctgttccagaagattacacgtacgaccacgcctggctcaccgactcacgtgggccagtaccagaaattctcccaaacaaacagtcgtgtctgaaaacaatcgcggtgacctccacggttagaaaagcctgttttcaagtcctggaattgccacatattagctgggtaactttgggcatcacatttactctctccgaatttcagattgcaaaaactcattggattgttttgtggattgaaagaaataatgtaaatttaggccgagtgctttgacttacgcctgtaatcctatcactttgggaggccaaagcaggagggtcacttgagctcaggaatttgagaccacctctggcaacatagtgagatcctgtctctacaaaaaattttttttaaattatccagcatggtggtacacgcctgtattcccagctactcaggagactgaggtgtgaggattgctagaacctgggagatcaagtcaacagtgagccgtggttgtgccactgccctccaacctcagtgacagaggaagaccctgtctcaaaaaaaaaaaaaaaagtagtaagtttaaagaacttagtgtaggcctggcatataaatgatattgttgatgttgatgttagcttgaaggcacatttataggagtagggattttataacattatgagcctgagagcacatataatgttcccggtctaacatgctccaactgaagaaaccccacacttgtccggcaaggaaactactacagatttcctgacctactgtgcaattcggggcatgcgacgggactgtgtttctgggtacgctgtctcaggttcgtctgggatgtaagaattcaacttcagtagttctctcatagacgccgacgagaggggcgtctcttttctctgatgaatctgccagatcttccacttcatagagtctaaatcctccgattcgatctactggagacccccacgttacaaaaacgtctaacgtcggtgacagctccccacatagggaaagatcacctgagtctcactacctcacattagtgctatctccagccccatgctatctacgagatggtcacgcgaggtttaaggggtctccgattccggtggtccgattcagctaatcgtggccctacgtgaacgatcactcctgctcgtaacatcgatacagggtcgcgctgacaaatggtactacgtaggttctcaggtcaatgccgcgtcacgaatgagcctaactaccccataagtgcacgtactgtgttacctttcctgttcggccaaacctgctactgtatgctgtgcttgtttaggctccatgtgctctagcctgattatcttttcaagtgttttatttgctaatctataaggcccctttcgtaaaatgttcactcattttctaattagatattttttttaatgttgagttttgagagttctttagatattttagatacaagtccattgtcaaatatgtgatttacaaatattttctctcaatctgtaatttagttttcatcctcttaacagggtcttttggagagcaaataatttgattttcataaggttcaaattattaattttttcttgtatagttcacacttctagtgttaagtctaaaaactgtgccttgtcataggtaccaaaggttttctccagttttttttctagaagtttagagtttcatgttttacattggagtccatgatccattgttaattaatttttgtatataggtagatgtttaggtttagggtttttttaaaaaaaaattacatatgtttaattgctccagttccctttcattgaaaagggtatccttcctccattgaattgcctttgtcagaaattaattggacatatttgtgtgagtctatttctgggctctttatcatgttacttttaaaaaatgcatcagttcctccaccaatacctcattgtcttgattattgcagttatatagtaagccttagcattaggaaaagtgtttttcctgctttattctttntcaaaaaatttttggatattctagggcctttacatataaattttaaaataactttgtctatgtctaaccgaaagccttatgaagattttgataagaattgcattatgcctatacattaatttaaaaagaactgatgtctttattcagttgattctgctaatctatgaacatagcatctctctcaaagcatttagtctttctttaatttctgtcattaattttttaaaattttcatcctaaagattctgtatatgttttgttgaatttatgcttaagcatttcactttcttggtaacaattataaatgattttgtgttttttattccactagttcattttcagtgtgtagaaaagcaatgaatttttgtgtgttgatctttgttcctacatcttgcaacattattgaactcatttattagttctaggaggttttttcatttttcttgtagataccttgagattttctatatagacagtcatgttgtctgcaaacaggcacagttttatttcttccttttcaatctatatgcctttttttttttttttgccttattgcagtggctagaacttctagcactatgtcaaatagcattggtgaaagcagacatccttgttccttgtcttagaggaacatttggtctttaatcttggattgcggcgcctccttttctcttccaaaatttctcttgtctagttatttgtccagggaaatttgaaagctcacttactgtgcaagtcagcaggaaacaactgggtctgtgcacagcacctagcaaagttctgctctaggaattacactttggccctgaggtagatttctacaagaaccttaccttctaagcagcactggggttcatctttttcccagtcctcagagcccattttcactcctgagttctcccccacaaaggacattttcaacgttgagtttattactcaacagaaaatggaatgaagtccaagacctaaggagatagaaaggggaccagttatggcatcttctcaccccaggacaccttgctgcatgtctctagtgctgaacagaccactggccttgctctgtagtttgaaatgctcgctgcaaccagaaaggcaccaaggggccagaccatgctctcctgtctatcacgccttcaaagcagaatttcccaaaccttgagtcacagtgctaacacacggggtgccataacatttttgttgattttggcattttacaaaaataaaataaaaaagttaaaaatgcattgctctattcttggggctggcacactattgcctttggccaaatccggtccctgactgtttttttaaataaagttttattgaaacacaaccatgctcttgtgtacatattgtctcttggctgcttcgaagctacaatagtgttcgctttttaacacttacctaaaattactctgtaatccatggatccttaatttatttaaaaaactaatgttaatgagtagctttattttcctcccatctaatttaaggcccacagaacaccttcacttacctcaatcctctcccaacttacatgcttttaatgtcatatatgttaataccgtatacttttaaaactttctaaaatagcattattttatagcatgagtgttcatttacatttttgcatatatttagaattttctttgctcttcgtttcttcttctatttatgactcccctctgggatcattttccttctacttgaagtacatagtttagaactgcactattcaatacagtagccactagccatgtgtagctattgaagtttaaactaagtaaaattgagtaatattaaaaactcagttccttcatctcactagccacatttcaagtgctcagcagccacgtgcgactaatgactactgtacatcaaacatatagaacatttccatcatggcaaagagctctattgatagtgttcatccagagtttctgttccaggaccaaactgagggttgggctgctatttctcatggcccaataacaagatgcagatgagctggggaggaagagagtttttatttctgcnaccatttaccgggagaaggcctggaaatcatcaccaggccaactcaaaattattacgttttccagagcttatataccttctaagctatatgtctacgtgtaagtgtgcattcacctgaagacgttagtgattaacttcttttaatctgtaactaaggtctgagtccggaagatcttcccctggagcctcagtaaatttacttaatctaaatgggtccaggtgctggggtaattacccttatcttgtcccctgctaaatcatggaggtttggggattcctttagagcaccaataaacttgtttgtggaggcctgggggtttcttctgacccacaataaaacttgtttaatcctaaatgggtcctgttaagaattccttctttattttgtcatattttaaggcccagaaaaggcctgggcaaaactcttgatgggcttttgttacattccagcctttgtataagaacactggtttttaatatttaacttaaccatttagtcagtactgaaacagttgttatagagatctgcattagtgagacctggcctgccacatttccttttctgaagatcttatggtagtgatcacctttgtgaaaggaaaataaatcttgggacctcaaaatcactaagccaaagaaaaaagtcaagctgggaagaatctgacacttaaatccaacactgctaactcattcatctcactcattcattcattttattttcttttttctttctttttttttttttttttttgaaacgaagtcttgctctgtcacccaagctggagtgcagtggatctcaggtcactgcaacctccacctcccgggttcaagcgattctcctacctcagactcctgagtagctggaattacaggcacctgccaccacgcctggctaatttttatatttttagtagagacggggtttcaccatgttcatcaggctggtctcgaactcctgacctcgtgatccgcacccccctcggccttgtttgcttgaggtactgtctaaatgctggaactgaaaatggcaagcaagacatccctacccttgaggaaactgtaatctagtcggaaatacagatgtcaaccaagtctcacacaagaanattgtacaaaacccctaggaggaaaaacctatcaccgcctcctatggaacttaaaacaaaaagaaaagtaacaaaggaaatgaatatttcattctggaagaacattgaaaaagaacaggaagaagagaaagcacaactcgaactgtccactagaattgacaacactctgacagaatgtctgaacctcatcgaaggggtaagtgaaaaaaataagctcctccagctttggcccaaagtcttataatttttaaacatattcctaaatataatataggagagatagccttcatctaagtagaaatttagctactcttgtaaatacagagtaataataataatgacatgcccataaacagtgtcttttgtgtatctgtgcttttataagcacttagctaagattatctcacataattatcataaccactgttactatgaccactttacaaacaaaactgaggcacaaagaagttggaaaactaatccaaacaaactggctccaaaaggaactttgctttctttgggtatcaagttctgaagagtacacatttaacattgaaactgaggtcagaaggcaagtttctatgtaaagttggagtattctgaatactctgggtagctacaaatagtatttaaattttatcttggattctgcagataaggataaaatagatggtaggcaaagagtatgatccttaggagaaatttttcctgaaggaaaaatatattaataaaaaatgatggaataaacttctaagatccttgcctagagcaaaactcattcagtcctttggctggtaatgttgaacatcaacaaaaaaaaggaaaagttcagtttaagtctactccaggcaacattttcacaacatccagttaaatattaactatttctctttgtggaattgaactagagttctttttcttatcctcttttttggttgttgtattatttaaaaatgagtacctttttattattgaaatcatttcaagtaatgcagataaatgatcagccctctccctgtacaaacatacatacttaggcatcccaaacttctctctggaggtgaccaccattgccagtcattcattctgttttcatgcatgtccatacagtataggtatgtcgagaaatgaagtattatatttttgtgagttgcaattcttttattcacatttttgtgtactttggttgtcttttcttgtgttttcctagtaccaatgttatgctgacttaggcagatgagttgagtattttcctttttgccctataaactgaaaatagtttgtatgacatgagaattatttttattttttgaaggtttgataaaaacttgcccataaaaatcgtctggaccggtttcttgaggatgcctgtgttagagcccgctttaacctgggctaccaatggttcgtcaagttctagattctctattaatacctttttcttgtgtctttctctggtctgttttcagccccgagtctcttagatctgtcctctaatattcctattgactttacttcattttctaagtctttatccttttgctttactttccgagagacctgcttaaccttatctcccaactcttttattgaatttcatttcttttactatatattttttactttgaatacacctctctcttcctcacattttcccccatagtattttgtcttcaattgacagttctactatcttattactctggagatattaataatagtttttaaatttttatttatttttattttcaaaacagtgtcttactctgtcactcacgctggagtgcagtggtgtgatcatggatcactgcagccttgatctctgagctcaagctatcctcctgcttcagcctcccaagtagctggaaccacaggcatgtgtcaccatacccagctaatttttttgtttttgaggtggagtctcactctgtagcccggtctggagtgcagtggtgcaatctgggctcacagcaacctctgcctcctgggtcctggttcaagcaattctcctgcctcagcctcctgagtagctgggattacagaaacacactaccatgcccagctaatttttgtatttttgtagagacagggtttcaccatgttggccaggctggtcttgaactcctgaccttgtgatctgcccaccttggcctcccaaagtgctgggattacaggcgtgagccactgcacccggccactaatttttaaattgttaataaagacgaggtcttgctatgttgcccagtatggtcttgaactcctgggcttaagtaatcctcctgcctcagcctcccaaagtgttgggattacaggtgtgagccactgaatctgacattttttaaaagttttcttctctttaccaagtcttttttcccctttctgcttttttgggttgttttattttgatctctatcttgctagaaactttctgcagacgtttagtaatactagatttttgagagtgggcaactggaaagctgattggaaactctgaatacatgggtgaggcttgttggctgtgagtgtcattgcttgatgtcctggcaaggccaatgggtttgggacccctactattagtataggcctgattccctgggaaaggctcttttgatctcctgcctggaggataaaggcctggctaccagccttctgtgtgtaatgtgagggagaagggctggagtattcaacatcatgctgaatcctttcaatgatcatcttgtttttagtaatctcctaccttaactctctgtcttctgctagtatgggaaagatgacctgaaaatctaaccatttatttttcccccattaatatcattttatgattattcagaagttaaataattgtcatgctgtcctccaaaaagactgaatcaactagcaacaaataagaattttctcacagctctgccagcattttaaaagaatagctttattgagcccaggaggtcaaggctgcagtgagctgtgattacaccactctaccccagcctgggtgacagagcaaaaccctgtctcaaaaaagaaatttaaggaacagctttattgttgtaaaatagacatacaataaacagagcacatatttaaattgtgcaacttatactttgatataaccctgtgaaaacatcaccacaatcaagatagtgaatatatttatcacctcctgatacagtttagctctgtgtccccacctaagtctcatgttgaattgtaatccccaatgctgggggaggggctttgtgggaggtgattgaattgtgggggtgcacttcccccttgctgttcttgagatagtgaatgagctctcatgagctccccttcactcactctctttcctgctgccatgtgaggatgtgcttgcctcttctttgcccttctgccatgatgtgtttcctgagtcctccctaaccatgcctcctgtacagcttgcagaactgtgagtcagttaaatctcttttcttcataaattacccagtctcaggtggctctttatagcagtgtgaaaaggaactaatatacctcctaagttacctcaagcttgtttttaattccttctcctcccttccttcattgccaagcaaacaaccacctgttttctgtcactatagattagtttacattttgtgggttttttttttttttgagacaaggtctgactctgttgcacaggagcagagcagcgtatccgcgttataggagatgcgaacttaagaaatgatgataaggagactttattaaatataattttgaattattttgccattacagaaattctaattatttaaaattctattcataatttttaatcactgtacttcccaagcttagcttagaatccttctgtgctgaggattaattttaatttgtcttttataggccttatctaaaatccaagaataattgccagaatcaaccaccttctaaatctgtaagtagaaattagtctttttaaaaatatgcattcataagtatgattagtaataaaaataataaagatgttagcaacctaaagaacatgtatttgaaaggtatttcttacagatataaaaacagtttggtttaataagagacaatcattttttgaaaagtatgacattttttgaaaagtagtttagttttattaaccaagaaaagcctcaagtgaactttagtcctcttgatagctaacatttattgaatgcttactgtgtgcctgatacttttctgacttgcattacctcactgagtcctcacaatcttatgaggctactattagtagccccactttacagatgagcaaactaagtcacagaaaggttaaataggtcgtatagctattaagtgacaaagctgagagcctgtgatcttaaccactttggtatgctgccatgaagttaaatagctcagtagtcattaaaagagaacatttgcattgaaccttccaagccacttaacaagtatatgcttcctaatcaatttaatttagctacattagatagaatggtaaaggatccttaacttaaagtttaaatggaagaaattagccctctgaaagaggcacagattattcatctgcaataaaaatctcacctttagttttttaaaacatagtttttatctgtgttctgaaatgtaactaaaacagtgcttcctgaagtgaaaaattctcactggtgagaattttaataagttttaatgattcaccaaatcacttcagtcatatttcagtcatatgcatatgcatatatagacatataagtttttatctgtgttctgaaatgtaactaaaatagtgcttcctgaagtgaaaaattctcactggtgagaattttaataagttttaatgattcaccaaatcacttcagtcatatttcagtcatatgcatatgcatatgtagacatatatatgttgtatgtatacatgacatcattagacactgtgaaggatagcaaaatgtatataaggcaaaatttatgaacaatggtttaacgtttgggaagcactgggttacacttttactttatgcagattgaaccagtatagtatgcaagtcttaaggaaaaatctactggaaagggccctcattcagacttcccagaggcttctctggaagttgacaatactgacttcagtacatcagctcgtaaatgaggatgatacctaccttatctgctttacacagttgtaaaagtaaaaagtgaactcaggaagggaattacagaatttaggagaaactaaaagcacgatgtaaataatagtcatcattacagttatataatgcttgacaatttatataacactttcgatacatgacaacaataactaacacccagacatgtttatatacattacctcactcagaacaaccatgtgaggaagttggccatatgctttaatgtccaaaccaggacacttttgagagtaaaaagcagtactctttgaccaacaggcataaatcaaaactatcttgtgaaaaccgggatatatggcatccttcctagataatagatacttttactattattaattttgctgtgaatctaaacctgctctaaaaaagttaattttaaaaagtaatgaagtactgatacatgctacaacatgggtaaatcttgaaaacgttatgctaagtgaaagaagccagacagaaaaggccacatattacatgattccatttatatgacacatctaaaataggcacatctatagacatacagagacagaaagtagactagcggttgccaagaactgcagggagcagaagatggggagtgactgccaatangaaaacgcattacgttgaatcgcaatgatatgtgccactttgcactctctgtgacatatataattatttttaatgcattcatttttttctcagagtgcattcgtttgaaaacatagacgggaaatactggtagtcttccttgtcagttagaaacacccaaacaatgaaaaatgaaaaagttgcacaaatagtctctaaaaacaatgaaactattgcctgaggaattgaagtttaaaaagaagcacataagcaacaacaaggataatcctagaaaaccagttctgctgactgggtgatttcacttctctttgcttcctcatctggattggcatattcctaatatcccctccagaactattttccctgtttgtactaaactgtgtatatcatctgtgtttgtacatagacattaatctgcacttgtgatcatggttttagaaatcatcaagcctaggtcagcaccttttagcttcctgagcaatgtgaaatacaactttatgaggatcatcaaatacgaattcatcctgaatgacgccctcaatcaaagtataattcgagccaatgatcagtacctcacggctgctgcattacataatctggatgaagcaggtacattaaaatggcaccagacatttctgtcatcctcccctcctttcatttacttatttatttatttcaatctttctgcttgcaaaaaacatacctcttcagagttctgggttgcacaattcttccagaatagcttgaaacacagcacccccataaaaatcccaagccagggcagaaggttcaactaaatctggaagttccacaagagagaagtttcctatctttgagagtaaagggttgtgcacaaagctagctgatgtactacctctttggttctttcagacattcttaccctcaattttaaaactgaggaaactgtcagacatattaaatgatttactcagatttacccagaagccaatgaagaacaatcactctcctttaaaaagtctgttgatcaaactcacaagtaacaccaaaccaggaagatctttattatctctgataacatatttgtgaggcaaaacctccaataagctacaaatatggcttaaaggatgaagtttagtgtccaaaaacttttatcacacacatccaattttcatggcggacatgttttagtttcaacagtatacatattttcaaaggtccagagaggcaattttgcaataaacaagcaagactttttctgattggatgcacttcagctaacatgctttcaactctacatttacaaattattttgtgttctatttttctacttaatattatttctgcaattttcccaatattgacatcgtgtatgtatttgccatttttaatatcactagacaattcaatcaggttgctacgttggtcccttgggtttactctaaatagcttgattgcaaatatctttgtatatattattgttttttctcctatcttgtaatttctttgagcacatcccaaagaggaatgcctagatcaatgggcacaaataatttgacagctcttattaaacattattctgtaagtaaaaactgaactacttttcagtatcactagcaacatatgagtgtatcagcttcctaaacccctccatgttaggtcattatgaacttatgatctaacaaattacagggtcttatcccactaatgaaattataagagattcaacacttattcagccccgaaggattcattcaacgtagaaaattctaagaacattaaccaagtatttacctgcctagtgagtgtggaagacattgtgaaggacacaaagatgtatagaattccattcctgacttccaggtatttacaccataggtggggacctaactacacacacacacacacacacacacacacacacacacacacacaccatgcacacacaatctacatcaacacttgattttatacaaatacaatgaatttactttctttttggttcttctcttcaccagtgaaatttgacatgggtgcttataagtcatcaaaggatgatgctaaaattaccgtgattctaagaatctcaaaaactcaattgtttgtgactgcgcaagaagaaaaccacccatgctgctgaaagtcagttgtcctttgtctccaactttacttcctttacctctcatatgtttgtgaataagcccaataagcagacncctcctacaaagtgaacctggtctctttcctcctaacaggggtcttgtaacacaggtaagacgagttcaagttttatttcttgnttttagaacggtagtgagcggttttcagcntgagaccacacctaaggtaagtagctgaattggggttttgtcttggctaaagtttaacaaccagctggtcttaatttctccttaccattagagcactcagtaatcatataagttgtgtgatcattcattttgcttaactgtttgtttctgtttttattgctgtttcagtctttttcccattgggtttgacctactctatctgacttgatcaaatccaaaggaaatttccaaattatggggaatgaggcctctgaagtggctaaattcccaccctcccacacacacaaacgtggtatggtgggggaaaaaacggccagcaaaagaaaaaaaaaaaggaaaagatgtttcattttgaccaccaaacgggctttatttacataacaaggccacctttttgctagccaggccatactgaaagagcaatggctgttgccccatgctgtgggttccatagctaacgttctgccttttttcctaccacgacagcctgggtttggttcctaaatcaagccttttctggtttgatacttggtaatgctgaaatagcagcaatttgtcctagctgaaatatcgtaataagattttaaaagatttattttaaaggacctcaatagttaaaagtcagcttaattaaaagctaacatccaagatgtgtgcatgtgtatgtatgcgtctttgtatttaaatagccctcatgttttttttttctttcctaggaacttgcctttttttgagcaaaagtttttttcttctctgttgactggattctgttttcttcatttacttctgctgtctctcctttctcttgcaccgtctgctgcatgagagccctaaaatagtttataatagcctggggttccttaaagaaaatggagaaggtgccaggctcccttttagggagaaacttctatttttccttatggaatccctagagtgtaaacagacaagttcatttcagctcttaaactgcttgcgtttgtgttgtgttacctgatttttttgactattatatttttgactagctattgcaacagaagctactcttgggttttcaaggaagattgtagtttagacatgtagaaatgtcttttaaaaaaaaaacaaacttttttttaagtgcactgtaaaagcatcatatggtctagcctcctaataattttccctttttggagaccaggattcagggtgggctctgcccagagctcagagatccagttaaaagagaggtagtctcggccgggcgtagaggcccagcctgtaatcccagcactttgggaggccgaggcgggcggatcacgaggtcaggagatcgagaccatcctggccaacatggtgaaaccccgtctctactaaaaatacaaaaattagctgggtgtggtggcaggtgcctgtagtcccagccactcgggagactgaggaaagaggagaatcgtttgaacccgggaggcggagcttgcagtgagacgagatggcgccactgcactccagcctggcgacagtgagactccgtctcaaaaaaaaaaagataggtagactcgatgttgtcgtacccgagcaagttagagcaacgccacactttgagacgaatttaagagtcctttatcagccggcgaccaagagacggctaacgctcgaaattctctcggccccttggaaggggcttgattttcctttatgctttggtttaggaaggggaggggagctcagttgcaacaattctacaggagtaaaaacatgcaaagaaattaaaaagacaagtggttacagggaaacaaacagttccaggtgcaggggctctaaatctatcataagatgttaggtatgggggctctgccggacacaaactcaaggctttatgctgttatctcttgagcgaaatcctgggaacttcgtacattgcttgcttcagtaccttatcagttaatcggactctttgatatgttgggagtcagcgtacacaagttaactccttgaggaagggggtgggtaaggagtccttgatgtctggtaaatgaaggagcgaaatcgagttcctctggctttctcagctaagggagagcttattcatgtggaaacaaggctaagtgattaagggagaaagggagagtctgaaaacaaggttaggtattacaatgtcaataaaattggtctccttatacagtcctatggtagatttctttccatctttaatctccctctagcaccaccagactttttctctctgtaccttgagatgtaaattttgctatctgaattttcgtctaagagttgtttcctttaatatgcaaatttagggttatttagctgacaactgccaaagtagtgaaacaagttatcaagaacttgaacgtctaaggtaggaaaaaaaaaagtctttatgaatctataagatgtacttctattggcatgcctaatacgtctatgtatttacgtgttgtgtacacagtttttcactactgaaaatatatagaggagttctaattaattgacttaagacaataaaagcgcttgaatcaaataccttatcaggaaaaaggaaaagacaagtcaaatgcttgttcaagtctatataacttaagtaaaatctttaataaataagctagctttaacattatttgaaatgtcttaagaattgccagcaggttctgggttacagaactagtgggggtgcagtggggtgagggttggtggggtgggnggtnnnacnnnnncnccccccccccccccccccccccccccctccccccccgccccgngcgggccgcgcccccccccgcccccccggcccgccccccgcggccccccacccccccccccccccccccgcgccccgcccccccccccgcgccccccacccccccgcccccccgccccccccccccccccccaccccccacacccggcccacacgcaccccccaccccgacgcccccgcccccccccccccgcagccgacgccccccccccgcccgccccgccccgcacccccgaccccccccgccgccccgcccccgccccccccccccggccccccccccgccggcgcggcgccccaccccccccccccagccccgaccgcgcgccccccccaccccccccccagcccccgccccccgccccgacccggcagtacgctataattccctcttcaccttacctcatctgttctctgatggatgtacttttttttttagtttctaaattcccttttcctttgctctggagatgggtgattgatgtagtctgggtatttgttccctccaaatctcatgttgaaatgtaatccccagtgttggaggtagggcctggtgggaggtgtttggatcatgggggcagatccctcatgaatagcttggtactgtcctctcaatagtgaatgagttctcctgagatatggttgtttaaaagtgtgtggcactcccccattgctctcttgttactgctttcgacatgtgacatccctgctccccttcgctctctgccatgattgaaagtttcctaaggcttcgccaaaagctgagcagatgtgggtgccatgcttgtacagcctgcagaactgtgagccaaaataaacttcatttccatataaattacccagcctcagatatttctttatagcaacataagagtggcttaatacaggctgggcatggtggctcacgcctgtaatcccagcactgtgggaggctgaggggggtggaacatgaggtcaggagattgagaccaccggctaacacggtgaaactccatctctactaaaaatacaaaaaattagtcgggcgtggtggtgggcgcctgtagtcccagctactctggaggctgaggcaggagaatggcatgaacccgggaagcggagcttgcagtgagccgagattgcaccactgcactccagcctgggcgacaagagtgaaactccatttaaaaagaaaaaacaaaatttcaaacagaacaaaatgaaaaaaataccaagtgaaaggcccctataaaaacccctctggggcccatcctcccaccccctcaagtgaaaccacatttaacaatttggtgcatatctttccaaaccttttgttgtacacatataaaaaacatacatgctttgatttggctcagactgtacatagtgttttccctcttgcattttacacttaatatatctttgacatctttctatgtcagtgcatgttggctcgatgatattctatcattaaatacccttccaaaaatggtaaaatcattttaaaaaatcattcacacaagtacatatttacaattttaaaagaaaacagaatcccaaaacacaacgacaaacctctaaaaataatctctatctttccaccagcatggaacagttcattcctttttcacataaaacgaattatgtgattggaaagattaactctaatctacacatttatatacagaatgttctatttgttaagcctatctgaaaataaaaaattcagatgattaattcacttacacttagaaattaagtcaatatactatgaatacacattgtgatcagttataatatgatgcttcttagtctagggtttcaattaaataacagtaaaaaaaattggataaataagacagctaataactgaaaaatccagaaattcaaagattatattgccaactaaaacactgccatttacatttttttttcctacttggtagcaaatgctaatggaattcaatcctgattacttaaagtcagttcacatcacacattcaatcaggataatacgaacataatatgcctactatagcgttagattaagacataaaatttttttgcttgaaagtaatgactgcgtaccacttgagacatttgtcaaccacttcagcacattgtttacgagtgactggatgtccacaaggaataaaaacgacagcaatatttctatccatacagattttgcaaagcttctcctcttgcaggtgtcttagctgctcttcagtactaatctctttctgcaatgaagtctgacttgattcgtcttgtgtactgtctttctgagccttcactggatctgcaatcagaacctcaagtgatttacagttgctcccagatgtctgaattttttcctccattattttcttaatgtctttgaaactgaaccccattcatatagcttcttgtaccataggattatggaagatggtatcaatttttctagttagtgatggcgttttttcagcagttcttaccagacactcctcaagtgaatgggataaatgaatattgtttatatattttcgtgtcttctgttctaacagatatttacaccctggatgccattaacatgttgtcccaagggtcttnctgggctctttctccctttttacccccattttcgtagggatttggttaaaacccatgtaaaaaatccaaacaccggcggggaacgggggttcaagctcgtatccccaccactttgggaacccaaggtggcaggattgtcggaagccaggcatttgagcccacccttgggaaaaaaaagagaacccccattttttttgaacaaaaaccccaaccctcccaggaaagaaataagtatggctgggttgaagtcaccaaagatggccgactggctggtcaagtaactttacctgatggttcgtagaatatttaccttcacccaggtgggagaattgcttgagccaaccctcagtgtggattcaggaacttgatttaattggtatcgtgattgtggattagattctcagggatgcattcactaagtaaaagtgataatagctacttttaagtaaaataatgaatgaatcaaacactctaaatccatggtgctatgctaagctctttctgtattttatctcatttgatattacaaatatttgatgtgttaatagtaatgactatctccatttttacaagtaaggaaactgacattgagagattaaaagactagcacaaatcacaaagtaaatgagatttgaatccggtcttgattccaaactctacagtattctaaattcaaggagactaaattataagatggagagccaattttactttataacagggttagaatggcagaagagacctgacattcacacctctagccagtgcatcatcttcctgtaggcaaatatgcaggaaatctataataagaacgtcctttggtgaaggccaggtgcaggggcttacacttgtaattccagcactttgggaggtcaaggtgggagggtcgcttgatgacaggagtttgagaacagcctgggcaacatagtgagaccctgtctctacaaacaaaaacaaacacaaaacaacttcaagaaaactcctttggtatggatcagaacaagatgaattatctatctgatccaaatgcttaatgacattaagccacagtccactcactgccacaatagagatatacctgccaatgccactcaggtaatcccatcaaaagtggtaatgaggtctgcagcatgacttgttcttagtgatcccagcctgagaccttgagattgcagcattttattctacatatgcacaaaacatctgttgaaaaatcttctaaattgatgcaatacattcgtatcaagaatacctgtctgtaatctccataaaccctctcctttctgttttaaaaaatagtaacagcatttctccttacatgacaaagaaatgacttcaccatctacgaaatagtgaataggagctgtgtggaaggaaattagctctacttcttggtggagatgagaagggagtgttcctctgaaaatcaaggctcttgtcatgctaggagccaaagtcgttttttagagtgtggacagttgagaagataagacagggaccatccactcatgtttttcttattccataggcctctctcaattgggcaaagcactccagaccttttggaagagtgacaccaaaggcaagcacctgcttggcaggcccctcagcttctacgcaagtataagtgagtatataaaatgggggtacttgtgctgttgagtaccttatttccaaatgaggcctgccggtgtccctgtggctgtgagaaggcctctactggataggtggaagttgtgtgttctcatcttttctaaccctggattgacttgcccaaaaggaagccattattaacactataataaaaccatccttaatctgggactctcttcatgcagtggttcttaaccagtgataaacatgagagttacttttggagcttaaaaaaattaagatgctcaaggtctacccaaactgactgaatctccagaggtgaggcccagggatgtatacttttgagccagacctcagtttaccctgcagagctcataaggttgcataacaccctttgtcagccactctgatgaaaagaaaaattggtgaggaataagttttagagaagaaggagcaaaggtgttcttggccagtgagagccaatgacagggaaatgcaaacaatgtatccacaagaaaggtaaattaccctatagagcattttaggataaatgaacatctcatgcctagggttgagagagggtacaaaaaaaaaaaaaaaaaagaccactctggatacacaacgcgataaatggaataaagaattttttccttgtaaattaaaaaaatcctttgttactgaggtataatttaatctattttatgtatagttcaatgaggtgttatagataataaattttttttgtaaattattatattgtcatatactcatacattcatttttaaaagtcagaaatgtatataaccattaaacttataaatcattcagtcattcagagatatagatacacgagcatattttatatccaccacaataattattaccatctcaacaattccatcacccctcaaatttcaagcgtaggggtttttaaatgtcaaaggagtctactcagtgggaagaaagttaaggaaaaaacctttggggctttgggctccttccccctggggttaaaaaggcaggaaattgggcttaccccccctgaaattgggaactgaaattttgggaagtttaaaaaaaaaaaaatcaagcagccttccttccttggcttcccaaattgttgggattacaggcatgagtcaggattcctggcttagtttacattttctagagttttgtataaatggaaacatacagaatgtatttttttgcggagtgggggagtgtttctatttctttctttccattttcccccccccncccccccgagacggagtctcgctctgtctgttgcccaggctggagtgcagtggtgcgatctcggctcaccgcaagctccacctcccgggttcaagcaattctcctgcctcagcctcctgagtagctgggattacaggcgcccgccaccacacctggctaattttttttgtatttttggtagagacggggtttcaccatgttagccaggatggtctcgatctcctgacctcgtgatctgcccgcttcggcctccctaagtgctgggattacaggcgtgagccaccgtgcccggcccaagtgtttctatttcttaaccagctttcatgcaatctttttttattttaccatctctgtgatcccactcccaaaggtactagatgtcgattggtccttaggatcagctaccatttgcccaactgctttccagccttccaaaaatttttttctttttttcttaaagatactcctgtgtgaggctcagaactcttgaattgctactgcaaatatgaactcggtgatgtgaatgccagggaattgcctgattgatcaaagaaatgtatccccttctccctcactcttgctgtcttctcatttgttttccccatccttgtggattcgtgaatttaaatatccctttaatgttataatattttaatggcgtttggcgaaaagtacagaattaggtgcaagagtgcatagctgttattttttttttggcctctgagactgttcatatatgcaagttatttaacagaaagttctgcagtgacctgagatgtcaggggggtctgatagagtacgtttgaaggcagttactggaaaaaaataatgccatttctggtttgtacttcggtaagttcagatgacccaatatattgtttacatgtggcattcagtaaaaaagtagcttcccctccctttcttcttccttttctcctttcctgcttctataaagcatctgctttgggaaacttcttaggaggagagcttgccagcccgtgggtaatggagaggtcttgcagagataaaagagatgctcccactcaatgcaggatggtgtggaggtaaatggggatacgtctggcatcactcaggaatgggccttcctggcagggaaaaaaagggaggggaaagaggaagggaattcnnanatnaattgctgaatacggggattccatggcctggatccaggaagagaactttgggaggtgtgaacctggaaggcatcanctgatgaggagcagcctgaactccggggaggacctgtttttggtggcccggaaaaaaatgccttccacacacagggaggccacccggctgatgggctgggggttggacggacagccctaggacaggcttgggaaaccaggctcaggtagggcctgcgaggttctcgctgcgtctctttccttcctggtcttagaaaatagaatccaaggcctcttgagagtggaaggtgggttgggaggagggcagatggggcttaggcccaggacacccgtagagctactgcccagctgtctctcagggactctgctgaggtcactccaaggatcattcttagccttgctagacagtactgacagagggaaccgtagtatcgcacccacttccttctctttcaatgaaagtttaaaggtcaccatttcctctggcaaaggaagttccacaaatattccatttccggtcttagaaacagcaaggtatcaagcaattgcaaacttcctgtgctggggaattcccaaggaagtaggggcagagttctggtggagacaaagtgaattccgagtgattagtcagtagcagtagcagtagcagtagcagtagcagtagcagtagcagtagcagtagcagtagcagtagcagcagcagaaccagaatttccccgcacgtgtctcaggctctcatttgccaactcagtctctaagtatttttattggcaggaaaaataaaatagctatgagtgaaataattcattagacctgagcctccatcaattttgtgtttaaaggcctgactctctttacctttccctgggatggaagatgcaaatgttcctgatctcactgtcaaaaaagaagaaccagtgggtatattgtatgcttgagttccagccattagtcacaagacatagagatgactgccatgtgtgtagactttctatagactgtgtgctaaacccgacctgccacttccaaggagtagatgaggaatgtccatggttctggggagccctaccccaatttggggcagacattccaaagctcattttctgtggagggggttgatggttaaaggaacggctgggatttactcttctttctagggccaagaaaatgacatgctgcctccatgtttaatcatccttccccctgttaataactatggctttaagtccccggttagggccttcctccaaaattggggaaaaaaattcccctccccccctaaaaattttttttttaaaaaaacctttttttttgggggttgggaaaaaaaccaaaaattttttttccccaggggttttttaatttaaatttctccccaaaaatttgtttttttttttccgcgaaaaaaagacccccccaaaaaaaaaaagttttttggcggaaaaaaaaatattttttttgtgttaagaaatggagaagaaggggggttttttttttcttctccccccacccgccaaaggaaaggttgttcacagattgttttgtgtctcccgcccatatgtgcctgcgaaatcatccttccagaaatatttgcccctttcttttgttatagagtggcactgccctatatggtgaccacttgccacatgtggctgttgaacacttgaaattggcttgtcagaattgcagtgtaaagtgtaaaacacataccaaatttcaaagacatggcacataataaaaaatgtaaaatatctcattaacaatttttatattgactgtgtaagtaacattttgaatatattggattaaatacatggatgatgccccaacacccacagtcccttatcaagtctctacttcacatttttgtacttctgacttagaaatagcactggcgtctaagagcctattaatgtcgtcaataggttcttgggaaccacaattttaaacaaaatgacatataagaaaacgaataacattgaacaaaatgacattattcgaggacctgctgcatgttgtttcacttaaagtcagtgtccaagaaactatcagtgacatttagtgaggaattgctgtccttcctgtttacaggaacctgggcaagttacttaattcctctaagcccggtttatatccctgcaaagagagaaggataataatcaccagtacttagtgatgtcgtaaggagaaaataaaataataaatatgaaatggctgacagtgtccttgtcacacagaagatgtgtgatccacagtagctgctattgtctgcctcacttcactagtaatggtccagggaggcctttaatgtgcatggtgcagtacattcacatgttggacatgggtgaagggaaagaccaggctcatctaaacacaataggatgcttgtggtgttttgaggaggaatcaaggactagttatccacagctgtaacatgcatggatcaaaagagataaggcacacaaaagactttgtcagtagcaaagcattacaaaatgcagagaccagctgtgggtggtggtgagtcagacccagcttccctctgtgcctggctgagtggttctgggcaagtcacgccatctgtcttgatgcccttccccatctatagagagggagcaactgaggccccttccaatactgaagtcctttatttctgctactttagaaatatccacatttttggtaaattcaaatgatccaatgattccatttcctaatgttcaaaactagccccagaaacatctaaatgaatcaaacaaataaaatatttattgtgtatgttttgattgctgaaacttctattttagcaacacacacacacacacacagaacccataagccttcatctttccttggataaacgagccttcctgtctggccatttaagtcacgattaagtaaatgatttccaactcgccttttgcagcagttcagatgggtctttcctgcgtggcagtggccctcctgacttatgatttcctgtgtgtcggcctgttaccactgcagcttaactgaggaaacaagaacaaaacagcctctgaccccaagagactgttggaggcaaaggcttcagtcccaagaacctcacacgtggggagcccgagagcccagccctgaccttttctccagtaataacataagaaacaacaggcactggccttattttggatacaaagagtggtgcttttccttaaatcttcctttagtcaggggtaccccttcatggacgccccaacatccatggttcctgcttgagtccctgcttccatattcctgcacttctcacttgaaatatccctggagtacgttaagcagccaggtttggaagttcttgctgtgcaggcgggtgtgtgcatgtcctctctctcaacaggacacaagctccccaaatcagacggtatgcctccacgccccttcccaagcctccccagcagcaccgagcatgtgaggggagctggggcccaggccatgatgggaagcactctctgcctaaagactagggtgatgcgccctcaactgtgggaatgagccccagctctggtgtctgcctcggtttttcctcctggacaatcaacatgaactcctcacccctcttatccactttgcataaactgaaaataacaaacccagggtctttctgtcacaggaaagggtttttttttataagattaaacagagatgattcaacacacccaggatataacacatgggccatgagtcaaggccaggcattgctctggtcagcctgttgtttgggcccccttggcagggctctcccctgaatcttccccctcttgactccccatcaccacagcacgtccagctttgggtacaaggccagtaaatggggaagggggtcagatgacataaagagccctttcctgtcccattgaaatatatttggataacagatggcatttccccctgtgtcttgcccagggcccagagcctccacttgctagaggcagacagaggatggagagccccttcattagtgggaggacatcacaggtgggcaagaaaccacaagcttgcactgaggcccagccttgaaatagcagcacctgccggcacctgtggtctggggacagggtcacaggatggaggggcctcctaagccttttatctctatgtactaagtacaacccattttcccacctcacagagccagatcagcctctgtgaggtcctggtggcaaaaggataattgcctgcccgcctgcccgcggtggggtgcttgtgcttgcattcctgggaaggttgttgggttactctgcaataggtctctctgaccagctcaccctcctactgcaaacctcaaaccaacttcaaagaagatccagcacccgcgtagtctaaagactgagtctgaagctgtcccttcctgctatggacttcagattttagcccacttgaattgctccatatcctccaagccatggccatcccttgactctctgggctcccaagcacttgctgccttcatcacacagtttgagttaaggcagaaagactggtttccatgtacactttgtggaagctttctcatttctttatataatctctgtcctttgtctactgctttaaaatctagaaattgtttacaaacacaaaggtgatcctttaaaagctcaaagctgattgtgtcaccaatatataccactcttaatggcttcccattaaactttgagtaaagactttatggagcctacataaggccatgactacctggctcttattttcctcctcatcctcatctcaccaactcactctccactcctatacccctcactccttccccctcctctctctgagctccagactcccaattacctacttccaccctttttgacccccagggacttatctcagcctggaattttccctctttgctctccactgaactgtccactcccagtctaagacatgtgcttatgtcacacgcccttaccgtgcttatctcagtttgtaattatctactcatttagaaaagtgttgatgaaggtcttcactgtcagctttcaggatagcaggaatcatagctgattttacttacttaacggggtttcattctttgtaactttttttttttttgagatggagactcactcttgcccaggctggagtgcaatggcatgatctcggctcactgcaacctccacctcctgggttcaagtgattctcctgcttcagcctcccgagtagctgggattacagatgcctgtcaccacgcccagctaattttttgtattttttgtaaagacggggtttcatcatgttggccaggctggtctcgatctcctgacctcaggcgatccacccacctcagcctcccaaagtgctgtgattacaggcatgagccacggcacccagccactccttttttacttatgggtgagaagccattagagatcatttcttcttttctttctctcttcactaaggcaccagggtcactaagtagtaggatactttgaactagaactcaagaaattgagttttaattttacctcacactctcatatgaattctccatgtgacctcgggccatacttcccctgtaccctgtttcctcttttataaaagtaagagtttaaactagatggtctccgacatgcatccttctctaacatattctggaaccttcaataaactaagataaagcagaataattaaaacttaatttaaaagaacacaggaaaggaagcagttacattaagcaaaagagacatcttcatggttgaagaagtgtatgccctggtgtctggatcccatttaggaaacttggtaaccttgcaatcttgggcagattgcttaatttctctagaccatgacttcctcttctgtaagatgtgataagaacatctacctcacaggtttcatgagaggattaaatgagataatgtattataatcccttgaacatggtaggctgttatgttaagtcctttcctccttctctgtagctatcatggaatttaaaaacacattataactagagcatgagttgcgactaaaggctcaattgtctctgcatgtgttggctcatgcatgctttattcctctgaagagcttttataccaagtgaaaggaaataattgcatttccctgaaaattcacaggaaaaagttatgtttttctcttcattcaagtgattctgttagacccaaccacatgcaacaattttaaagttgcttccaaatatatttacaaatatttcctgtcttcaaggaacaatggcaagaccatgactcaggttcacatccggattccaccactaaccatgtacccaattacttcagtcaccttcattcaggtcttacatatcacagaataaaatcagatttcatcagaggaggtgaagacagggagaggagatatttcaatcccttctccgcaacccccgttttttttttttttttaacaaggatcctagagttactgaatgatagcacgtttgagggggaaagaccctaaggatgatctttataagccatcacttggtgttggtggtgataaaaaactcgagtatctttatgcagtggaaagagaagattggactcggaatcagaagcttgagttcaagcactggtttcatcagtcttgtgatcttgggttggtcacttaacctcttcaagggtcctcagctgtgaaagaagatagtatcagctaattcttgtatgtgcagtgaggaggcagtgagatagtgcaggtaaactataaaacaattgtcacatgaaacgcatcacagtgattctttggacccacaagctccaatcttataaaacatatccagtcacccaccaacatagatcatctcaccttgcatatctgattttgtggatcatggggaaaaactgctgattcctagcaaaacccatggcataggataagtgcacaataatttttttttcctaaatgatttagatgacagtgactcattaagggtttcctgaggcctcctcagagtcgagaggtgggtgcctgaagccacccaaagtccctgtcacaggatggctcccaacgcacacaccacaggcctgcccagtatgttccactatctacccagtagagccctgcccagtacgttccactgtcccttccctagaagaggtgactgttgttcacagtcccagaaaagcgggctccccaaaacaatgcaaggacccacctctctctgaacctcacccaccctagttttcctttaaaaatcaatttacaagaagatcatgtgaaggaaaaggttgggtgatattctaacccaagttagctgtttctcaaccaagttctctttgaaaaattcaacaaccacctttggggaattatttacaacagaggagtgaggatgggaccaggataggtattgcctatgttggtggaaccagggtttttttcctggattaccaaagagatggtatgcattgctcccagaagctaaatatcttcaggctttcaatggtggccttcacctgaaaatgttatccctgttgaagctttcaagccagtattttcataagaactatattttctttggtgaactgaggcattataatgatgactatacaggttcttgagtgactgaagccatcattagcattgtcattatttttgtttagttgcatctccatagcagctcacattcacaatgtgctttgcaattgttccttagcaatagccctcacaagattctcaggaggagagggttaatccggattaacatttctgtgaagcctagcgagattaatcgcaagagttttaaaattaagtaaggacgccgggaaacaaatcaatcccagcaaacattttgttgggatttatcattcaagcaattttacagttatccctgtcaaatacattaagtgttcaaaattgggcatagggggaacaaaataataaacccagccaaaacagaataatccctgtttgttcaatgttggataaaaaagacattactattggtgtaaggaaattagatacatcttccattatttagtaaaattaccataacttctaactttgtggctttaggcagtctagtccacaggcaggaaggaggtttgttttggcaaatgactgttatcatcttctgtttcaaagctaaaccataaactaagttcctcccaaagttaattcagcatatgcccaggaatgaacaaggacagcctggacgttagaagcaaaatggagtcaggtaggtcagatcttcttcactgtctcagtgatggcagtttcataactttaaatgatggctatcacagttttcataaataatctagataaacagttaaaataaaataattaggtaaatgtagtgcgataaatattagtagacaaactcaccataatttagaatctaaagttaaattaaataataatatttcattatttggtattttccaagaaaaacatattgtaggaaaccattctttttaaaaaaaaaagtgtccttttaaaaaggtgaataatttttgtctaattcaaagtttattgaaaagttatgtataaaacaaggtaaaaggaacaaggaaataagggaaatgtaaagaaaattatagaaataaagtggtattttttggtaagaaagcttaaagagaaataattttaggtaagaaagaatcttacctaaaattttgtgctagaataaagtgactggctaagaaagggatgttcaaagctatttatgacaaacccacagccaatatcatactgaatgggcaaaagctggaaacattccctttgagaactggcacaagacaaggatgtcctctctcaccactcctattcaacatagtatcggaagttctggccagggcaatcaagcaagagaaagaaataaagggtattcaaataggaagagaggaagtcaaattttctccgtttgcagatgcatgattgcatatttagaaaaccccatcatttcagccccaaaactccttaagctgataagcaacttcagcaaagtctcaggatacaaaatcaatgtgcaaaaatcacaggcattcctatacaccaataatagactaacagagagccaaatcatgagtgaactcccattcacaattgctacaaagagaataaaatacctgggaatacaacttacaatggacatgaaagaccttttcagggtgaactgcaaaccactgctcaaggaaataagagaggaaacaagcaaatggaaaaacattccatgcttatggataggaagaatcaatatcgtgaaaatggccatactgcccaagtaatttatagattcaatgctatccccatcaagctaccattgactttcttcacagaattagaaaaaactaatagccaagacaatcctaagcaaaaagaacaaagctggaggcattgtgctacctgacttcaaactatactacaaggctgcagtaaccaaaacagcatggtactggtaccaaaacagatatatagaccaaaagaacagaacagaggcctcagatataacaccacacatctacaaccatctgatctttgacaaacctaacaaaaataagcaatggggaaaataattccctatttaataaatgatgttgggaaaactggttagccatatgctgaaaactgaaactggaccccttccttacaacttatacaaaaatcaactcaagatggattaaagatttaaacatggctgggcatggtggctcacgcctgtaatcccagcactttgggaggccgagatgggtggatcatgaggtcaggagatggagaccatcctgactaacacagtgaaaccctgtctctactaaaaaatacaaaaaattagctgggcatggtggtgggcgcctgtagtcccagctacttgggaggctgaggcaggagaatggtgtgaaaccaggaggtggagcttgcagggagtggagatcacgccactgcactccagcctgggcaacagagtaagactccatctcaaaaaaaaaaaaaaaaaaaaaaagaaggatttaaacataagacctaaaaccataaaaaccatagaagaaaacctaggcaataccattcaggacataggcatgagcaaagacttcatgattagaacaccaaaagcaattgcaacaaaagccaattgacaaatgggatctaattaaactgaagagcttctgcacagcaaaagaaactattgtcagagtgaacaggcaacctacagaataggagaaaattttttcaatctatccatctgacaaagggctaatatccagaatctacaaggaatttaaacaaatttgcaagaaaaaaaaacccatcaaaaagtgggcaaaagatatgaacagacacatctcagaagaagacatttatgtggccaacaaacatgaaaaaaagctcatcatcactggtcattagagaaatgcaaattgaaaccacaatgagataccatctcatgccagttagaatggcgattattaaaaagtcaggaaacaacagatgctggagaggatgtggagaaataggaatgcttttacactgttggtgggagtgtcagttagttcaaccattgtggaagacagtgtggcaattcctcaaggatctggaaccagaaataccatttgacccagcaatcccattactgggtatatacctaaaggattagaaatcattctattgtaaagacacatgcacatgtatgtttattgcagcactattcacaatagcaaagacttgggaacaaccctaatgcccaccaatgatagactgtgtaaaaaaatgtggacgtataccccatggaatactatgcagccataaaaaagaatgagttcattcttttgcacggaactggatgaagctggaagccatcattctcagcaaactaacacaggaacagaaaaccaaacactgcatgttctcactcataagtgggagttgaacaatgagaacacatggacacagggaggggaatgtcacacaccagggcctgtcaggaggtggggggcaaggggagggataacattaggaaaaatacctaatatagatgacgggttaatgggtgcagcaaaccaccatggcacatgtacacctacgtaataaacctccatgttcttcacatgtatcccagaacgtaaagtaaaatttaaaaaagaaagaaagaaagaaaaggatgttcacgacaaaccagaaagtccaagcatgtcatgaatagtctgtgtaagtcacaataagaggatttatttaaaaaaacttttatatgataaagttgtctataattaaagggaaattataatggtctttctagagattgggttgatgttaaaaaactacttatatattaaaaaattggttagaacaatgaaattttcttacggggttgattcactcttaataaattataagagacttaagaatttttttttaacccaaagttcagcttttattgcatcttgctgttttaggttttctctcccctttaaaagggtgggaaatagtaatgccctccttcaactcccttcagctcatatacgttttttaccctcagattctgtttgttgtgtcctgatgctaacaatgttttcttaaaggtctaaaggaaatgttttcttccaacataatattctgtgcattgcagaaggtcttttcttttgccttttggtaactggcttaacagattttatgttttattgaaataatttctatgccattattattaagttttggtttgcttagaaaacactgagattaatacaattttttaaaaattatgattattacatccatatatctttatgtatgtgcttttaaagtccttgtgacattgagttctagggcttgactcctgggtcttaaaaggacaagtcctgctaaatcttaaatactgacagcaattaaaggctcatcttcaggactggtagaaaatgccaatcaaaataaactgcattcttgaaacacagagccagaaattaaagctattcaactcaaggcccaggaactatagtggaagaggtgggtgtgtgagattgtaagggccaattttgagagataaaataagttcaatttctctataaattaatcataatcattgatgtccaagccacactgatgcaagatcagcatatgggtcctgtgtcagattaacaaggttttcttgaagcattaacctactccttaataaaggttatagaggttataaaaggcttctggaagttatagctatggtcaagataaaaatttcatagattgttaatacaattttggaaaacaaatttaattggcttcttgctgtttttattagggcttattgtttggaaaattaagtctcgtctctcaaagaatgaaggctttcaccttttttttttttttttttaatccttgagttatcactttggtcaaatgaatgacttattttacaatgacctttcatcaagtgttttaaacctttcaaatttgacaaactttccaaaatcaaactacaaattatgtctttttatgacctaatgaatcctttaaaatactaggttccctaaagtccaaaaaaaaaaaaaaataacataatgtggcttatttggtataaaaattttacaagaaacattgtcaaatataaaatattgtgtggttttgtttgggctgtatttgtataaatatgttattggtatgtgttccaaaattataggaaactcctataattctgatatgacttggtgtacattatcagtaataattataattgttatggtaaattattgtgtgccatggaggtaacaaatttcctcatcaagtgtgtctttgactatggttgccctaaaactttttgccattcacagacaattgtcttgctttggtcctctttagaaggtggttttataatcagctataaaactctaacgggtgctcttgaatgcaggcttaagatagctttggagactgtgacatcagaatagaggaaaaactttcagtattcatggagtgctgaaatattcatgaatatcaagcaaaacaggaattaacttcatagatggaactaaaagaatgctgaagtaatctttttgactttttttcttagaatgttgatccttcgttttgtttttcagagtcnaggaaatttttctgttgagatattgacagctttaacaattaagtatactccagtgaacacaatttggagcaatctagtcattccccagcctgaccaattcaatggcccccatcttagttaaaattcctcaccctgacaaggccccatctacgcctctgacctcatgccctccactctcagtcttgcactcaccctgccacactcaagggcttccccaggttccttcttagattccaccgatagctcagggactttgcacatgctacggtctctgcctggctcctccccagatcttctcatgcctagctgcttctcatcagcacccctcagagactgtccctgccccacctctccaggttccatacctgccaccctcccccaatcacgtaacagtttcttcacagagcgagttaccatcccagtatttccctaacttattttttgtgactggtctgttgcctgtctccaccacaagaacataagctgcatgtgaacaggagccttgtctatcttgtcaccccagtggctgtgacataacctgatacacattagatgctcaatgatgtttgatgaatgaagtgctggtagtccaactgtgtttccttgtctgtgtaagtatgtctgttgtggtttcctaagaacctacagctctcccactgtgactcctgttctatggtcctgatttgctggactagaatcctaacctacatgcttactcttagtgtcctcccccagaggctgaatcccagtccctaaacctccaccaaatggctaagacctagcttccaaccagacaggcctacgctgagacctcagcaccgcccttctgcggtctcatccttaacgcatccttcagggcccagcttaaatgtctcttctccaaggaaggctatcctctttctgcccctcagtgctctccatgcctcctctatgcctccatgcctgctttcaaccctgcagaagtggagaaattgctaatctgctgtgttgacactgtgctggggtgccttgggccagggagcaggctggtggtgtgctgatagcccgtggctgtgcccaggtccatgctcacttcctgagccccagtggagtaggctccctttcccttattgcagcactcagaggaaggacgtgcttcttaggacagatctggccaacctctccctcgtgagagaaggcccagccatcctcttgccctctttctttctcctgcccccgagtaataaaggtgcctggtcagagccttctagaaggagacccaaacatccaccacacattcccagttccaaccgtcatccacatggctggctgtgcaggtaaacgcagagtctgtttcacacacccaaccatctagtattggatgggaggacagtagcgtgacactcttctccagccttgagccctactgtgggccccacccaacccagataccagaggagccctgtactgggatgctattggatgcttgtccagtcatgtacaaagttagccctttgttatatagagttagctacgtacatcttcctctgtagggaacccaagaggggagaagagatatgtagtaggatttaacctgcaaatcctctgctgagcaccctgcactacatacagtgggtagcatgtggtaggtgctcaataactattgaccgatagattgaatacaggtaggatggtgacacaatctaagatcccaggggtggggagaccacacgcttggttagggagacccaaagtggaccgtgtggccagaagagtcccgcactgcactctagtgacagtgcagaaagtcactgtgggaaatctagaagtttctacaggttgctatttcatcatagcactgtgcaggccaacccttcctgctccactggctgttgggaaaagctttctcttttcttcctagccagggagctctcaaagtgttccactctctcacctccacccaggcgtccaggtgtggaggacacttgccggctgcttgtctgctgactcatcccttggtttcacttggaaaacctaccaccagctggcctctttccaagcatcagcctcctcattttcttaatcccttaggtgtgatctcacctccacacagtagattgcctcaaggcccaattccaatatgaataaaaatgattattttgtcatcttccaatcttccttttaaaatattattttataattccctttaggaggatcacctaagtgaagactatttttacctaagaaatgttaaaatgtaaagacatggttgtaatctggggattcctgttaaaatggctagcagacagaagtcagacgacaggctagaaatgtgtgaagagtggttgcctttgaaaggcggagttggtaatgattttcttccatttttccatgctttccaattctctacaaaggccttaatattacttcgataaccaggacctctgataacctgcccccaccgagtaaagacttagctgggaaagtcagcttcatgtgaggtaaaaggaaccaggtaatacacaattcccactgccaactgtcgggtgtgcaggcctgagcttcctgcatgtgggaggaaagagaaagaagagagaaactccaagatccaagagatccagcaagaaggctggagtctgaggacgcagaaagctgaatggcacagttaccactattgtgctgaggttctgtggcctctgggtctcttgacaactgggcaaagacccacagaaaactatctctagaccctacctgtgggaggggaaagtgcttaagatcatttacaggacagccacctggacctcaaatggcttacagttccttcatccagagggtcttcatttagtacataccaggtgctaagctgggtgctggagacatgacggggaacccatttaccatggctttgttactgtgacattcacatctagggaaagccagcaaaggggagggatcgaggagagcttgttaggcagagaaaatacccaagggcaagggagaagccagcctgttctgagcacacacagtggttccatctaactgggcctcagtgccaggttggactggagatggggctgaggagctgtcacagagcattctggacacagatgtcacatagtcccttgaggttagggtccttaggcatggcagcattgctttgagtttttccttttgtaatgttgccattcatgacaatgtggaagatgggtccttgcagagaagggcagggctgtgagaccagttaggagactaagatgtgagccaaggaaaatgaggaacacctgaacactggggcaggtgcagggcccagagagaagcagatggcttcctgaggttttaagtaggtagaatcaaggcagctggtacagatcttttattacatataaactggaataagccatctgttccaagacaaaagagtaggcggaaaacaatacaagacagaaatggaattagaacaaacctgggaggaatgtggaattagagtagagagtccaacactggctgcaatcataaaaatgtaaaacaaacaaaaatttgctaggtgtgcttacttagaaataattagctgtcatattaagttcacttgtgttatggcttaaatgtgtcccccaaaatgtgatgtgttggaaacttgatccccaatgcaacagagttgagagatgggacctttaaaaggtgattaggtcataagggttctgccctcataaatgaattaatactgttatcatgagagtagattcctgataaaaggatgatctctgcctcctccccacagccctcttgtgcatgctttcctgcctttccaccttctgctatgggatgacacagcaagaaggccctcaccaaatgcagctccttgatcttggactttccagcctccaaaactgtaagccaaacaaatttctgtttattataaattacccagtctcaggtattctgttctagaaacacaaaatggactaagatcattaaattatcattttttatcagactgttgaaaaatataacagagagtaagaggaaaattaccttctttctttttcctttccctgcctgaccttattcacctcccatcccagagcatccatttattccattgatctttactgacatctattatctgacctacacaatactagacattaggacaatgtggcctgcctccaagaaactcaaataagccaactgagatcagagaggattaatcacctgccaatgggcacaaagcaacaagctgggagccaagtcccaaaatggggcctgctgcttccagttcccctctctctgcattgatgtcagcattatccttcgtcccagtcctgtctccactaccactttccccctcaaacacacacacacacaacagccttagatgttttctccactgataagtaggtgactcaatttgtaagtatataatccaagaccttctattcccaagtagaatttatgtgcctgcctgtgcttttctacctggatcaagtgatgtctacagagtagggcagtagcttcattcatgaactcattcaacaagcattattcactgagagccttgtatttttcaggcatagtgccaacagcagtgtggacagtggtgcatcaaagcctctagtctcatagaacttagtcttctggaggatatggaaaacagacaacccaaacaaccaacaaaagagcaagatgctgcaaaaaaaaaaaaaatgaatagggtgctaagatagagaaaagtgggagagtgctatttagacaaagtggtaaaaacaaagccccttgtgagatgagagctgccgacaggagggggcgggtcatggttgtgggtttttgggtaggacattcagaggagggggcgggtcgtggttgtgggtttttgggtaggacattcagaggagggggcgggtcgtggttgtgggtttttgggtaggacattcagaggagggggcgggtcgtggttgtgggtttttgggacattcaaaagagtctgaatgcacccaggcctacaacttcaagatggtaaaggacagctccaaggatcagaagaagcatgcttggaactggggcattttgagaaggaggaaaaatatgcagagactagtgcttgcagagcttgcatgtggatttcatttgaggtacaatgaaaacccattaatgggtttcacacagtgcaatggcctgacctcacttatatttcctaaaatagaaaacagatcagaaggaaggcaatagagaagcagaaagtccaatgaggaggtttcacagcagtcatgggggtggggtaaggaaaagaagtggaaagaaacagacagaattgggttatattttggagatagaaccaacagaaggaagaggagaaacaacatttactgagaagggaaaaagtaggagaggaataggtttgggaaataaatcctgctgacattggaaaccccaaggaagcctcaaaagtatatttacttgctttagatttaaaagaataggaaagaagcatctcaacttggaatttgaaatctatttttccataaaagtattgttaaattctactcatactcacaagaaaagtacattctaaagagtatattgaaagagtttactgatatacttaggaattttgtgtgtatgtgtgtgtgtgtatgcgtgtgtgtgtgtttaaccttcaattgttgacttaaatactgagataaatgtcatctaaatgctaaattgatttcccaaaggtatgatttgttcacttggagatcaaaatgtttagggggcttagaatcactgtagtgctcagatttgatgcaaaatgtcttaggcctatgttgaaggcaggacagaaacaatgtttccctcctacctgcctggatacagtaagatactagtgtcactgacaatcttcataactaatttagatctctctccaatcaactaaggaaatcaactcttattaatagactgggccacacatctactaggcatgtaataaatgcttgctgaatgaacaaatgaatgaagagcctatagcatcatgttacagccatagtcctaaagtgctgtttctcatgaaggccaaatgctaagggattgagcttcagtcctttttctaacatcttgttctctaacagaattctcttcttttcttcataggagatgcctgagatacccaaaaccatcacaggtagtgagaccaacctcctcttcttctgggaaactcacggcactaagaactatttcacatcagttgcccatccaaacttgtttattgccacaaagcaagactactgggtgtgcttggcaggggggccaccctctatcactgactttcagatactggaaaaccaggcgtaggtctggagtctcacttgtctcacttgtgcagtgttgacagttcatatgtaccatgtacatgaagaagctaaatcctttactgttagtcatttgctgagcatgtantgagccttgtaattctaaatgaatgtttacactctttgtaagagtggaaccaacactaacatataatgttgttatttaaagaacaccctatattttgcatagtaccaatcattttaattattattcttcataacaattttaggaggaccagagctactgactatggctaccaaaaagactctacccatattacagatgggcaaattaaggcataagaaaactaagaaatatgcacaatagcagttgaaacaagaagccacagacctaggatttcatgatttcatttcaactgtttgccttctacttttaagttgctgatgaactcttaatcaaatagcataagtttctgggacctcagttttatcattttcaaaatggagggaataatacctaagccttcctgccgcaacagttttttatgctaatcagggaggtcattttggtaaaatacttcttgaagccgagcctcaagatgaaggcaaagcacgaaatgttattttttaattattatttatatatgtatttataaatatatttaagataattataatatactatatttatgggaaccccttcatcctctgagtgtgaccaggcatcctccacaatagcagacagtgttttctgggataagtaagtttgatttcattaatacagggcattttggtccaagttgtgcttatcccatagccaggaaactctgcattctagtacttgggagacctgtaatcatataataaatgtacattaattaccttgagccagtaattggtccgatctttgactcttttgccattaaacttacctgggcattcttgtttcattcaattccacctgcaatcaagtcctacaagctaaaattagatgaactcaactttgacaaccatgagaccactgttatcaaaactttcttttctggaatgtaatcaatgtttcttctaggttctaaaaattgtgatcagaccataatgttacattattatcaacaatagtgattgatagagtgttatcagtcataactaaataaagcttgcaacaaaattctctgacacatagttattcattgccttaatcattattttactgcatggtaattagggacaaatggtaaatgtttacataaataattgtatttagtgttactttataaaatcaaaccaagattttatatttttttctcctctttgttagctgccagtatgcataaatggcattaagaatgataatatttccgggttcacttaaagctcacattacacatacacaaaacatgtgttcccatctttatacaaactcacacatacagagctacattaaaaacaactaataggccaggcacggtggctcagacctgtaatcccagcactttgggaggccaaggtgggaagatcacttgaggtcaggagttcaagaccagcctaggcaacatagtgagatctcatctctacaaaaaaaaaatgaaaaattaaaaaatgagctggacatggtagtacacacctgtagtcccagctactcgggaggcttgaggtgggaggatcacttgagcctgggagatggaggctgcagtgagccataatcacaccattgcaccccaacctgggcaacagagtgagacccagtctcaaaagataaatttttaaaaatgttaaaaaatatataaaagagaattttaaaagaacaactaatagatcaaagcatggatgcaagatatatttagttggaaaatcaaggttaaaatcaagggatcttggaattaggtgtggtagatttgggtaaggagtagtctaagatgaccctgtttcttggtactggagactggatgagtggcagcgtcttaaccatatttttggtagaaatatggaggtcttctccattccaggatgaatgatgagtaaaattttaggcatgtaatttgagctactagaaggacactcaattgcagatgtacaatggggagatgataacctatctggaactcagaaaaataactgtatatagatatgaaagacatcagtaggtatgtagtagataaaatcctaaaagtgatgtcaaagggagaagagaagtatatggtgaacactgttgtttgtccatgcaattgccatctcttcttcttccttactgacagaaccctgatttcactgagaagtcaacatgcccttccccaattgatgaatccaattggttgaagattatgttcattctattcttacatgactaagtcacgttgacttaatcctatcaaatgagatgtcgatctggaaacaacttctggaaaagattttctaccttgataaaataaagagccatatagatggtcctttatcttccttcttccttgaatgagatatgttctatgaggaagtgaagcttagaactgtggtcagcaacttgcaacgactgggaagtcagagccacacaatgaagaatgcagagtggaaggagaaaaagagccagcatctctgacaacattgttacaccgagaacctacctccagattttaagaaaacaagaaatgctactgttattaagccatttcactgggtttgctatgacttgcagtcaaatctagcttaactgatacagagcaccacagagaactggtctctcatttgtctcatcctgttctttctagcagccacgactttcctagggtttccttagcccaagtctggctagagcaagactaagtaagacttgattccttaatgtccttttgttttaagaaatattaaagaattatttttatattaatatattttaagaaataaggaaatacaaaacactgagcaagcaacacaaattcaagaaatcttaaaaagtataatagctgctcagtctctgattaacagtgaaatatggaatcattgtagaaatggccttggagcgttattctcccaggccagctatccttatggtctgccccacctccctcattgcctaaacagtaagagagtcccatggtgagactcaacagtcttagcacagaacttgttacagtctatttcttttcttacagtcctatatatcaattccaaatcaatgagagtaaagcccaatccctgcctttaaacccaaaggacagaagcccaaagcccaaagatattccctaaccttctccccctcctgtcgctccctatgtttaaagctggggatctctttttcctgtgtctaattattttcctcattggcttgaaaaatctgataaaacattttaggactgtgtataaaatagaattagccaagtgcaatgtctttattcagaagaaatttcatggacgttgtgcctactctcttggcttcctggcttcatggctttccagatcccacagtaagctctggatagtagaagttatagtaagactgacttctaaataaatgaagtgactttaaccttactgatatggcttaaagaaaaggagtggcctttaagatccatgaacttctcaaacaaaagtgataacgttatctccatgcatatataatactaaatataatgcaactgagagaagtaggctgtggtaagaaaggagacccaagtgccatctgaaggcagcacttaccactctgcttcatcccaccgaggaaacaaagcatgagtattgccagattttcttctgtttcaagaaaagccagaaatccaggtttttgcgtgaaatgtcctgattttaatgttgggaactaatttatattttgaaataacattgtgtgggacaagtgaacttgtatgtggaactgctttctcccagtggcgaccagtttggaccgttgatactcagcaagttcagccaagtgcgccttgtcattgtcagtcatcaaggtgatgtgtgattggtcaaacaattagttttgctcagcatctcgtgtgttttcaaaggacctgagggttcatttgcccatgcagatcttgtagtcctgtttattctattaatttatcttgcaaatctataatgttttattttaagcagcgagagccgtggcagcctttggtctggaccctttctaatgatcatttagtatcaggctatgtgggagttgattgttttgcattgcctgaaagccaacagtatcactcctcctctaggtgtggcagagatgtgagagagggagactgacagtctgtgggtgtgtatgcagtgttgggggaagcgaggcacaggggacaatactgtggtgtataaaactagtctaaggtagcatcaggaagttcatgaagccaaaatgattttcataacagcacaagacattatttgtttttgcctccctctcatttttttttttttttgagacagagtcttgctctgtcatccatgctcgtgtgcagtggtgcaatctcggctcactgcaacctccacctccagggttcaagcaattctcatgcctcagcctcctgagtagctgattacaggtctgcaccaccccgccggctagtttttgtatttttagtagagatggggttttgtaatgttggccaggctgccctgtcattttttttttactagtgtccagtggagttttttaggggctacataacatgatactgtcattaatctaatggctaatgaaagggatatgtatatgtttttgtgtttaaaacaaacttctttggggtcctcaataatttttaagagtataaaggggtcctgagatcaaagagtttgagttctgctggactgggacagtggttgtcaacccagattgtacattagggtcatctgggaagctttaaaatagtactgatgcccaaccttaccgcaaaccaattaagccagaatctctgtggatgagaagtcttcattgtcatcatcaccatgaccatcatcattgtcaccgtcactacaccattatcatcatcatcatatcatcttcattatcattgttagtatctccatcaccatcatcagcatcaccattattatcatcatcatcatccccaccatcatcctcatcggaacttcacctgcatggaggacaatccactatgcattaggtgctatgctatttgctatactccttattctcacaactgcccagagaggctgatattatctcactttataacaggaggaatctggatcggaaaagttaaggtaagctaattcacagagcgagaagagatagagccaggattcgaaaccagttctctgctacatcaatgttcccagtccttgcactattgagaacctctttagttatgctttcacccctccaacaccacagtaaattttttctttttttaaaaaaattatactttaagttatagggtatatgtgcataatgtgcaggtttgttacatatgtatacatgtgccatgttggtgtgctgcactcattaactcgtcatttacattaggtatatcttctaatgctatccctccccgctctccccaccccatgacaggccctggtgtgtgatgttccccaccctgtgtccaagtgttctcattgttcagttcccacctatgagtgagaacatgtggtgtttggttttctgtccttgtgatagtttgctcagaatgatggtttccagcttcatccacgtccctacaaaggatatgaactcatccttttttatggctgcatagtattccatggtgtatgtgtgccacattttcttaatccagtctatcattgctggacatttgggttggttccaagtctttgctattgtgaatagtgccacagtgaacattcatgtgcatgtgtctttatagcagcatgatttataatcctttgggtatatacccagtaatgggatggctgggtcaaatggtatttctagttctagatccttgaggaattgccacactgtctaccacaatggttgaattagtttatagccccaccaacagtgtaaaagcattcctatttctccacatcctctccagcacctgttgtttcgtgactttttagtgattgccattctaactggcaccacagtaaatttttatagattttataagcaaattgtatttactgtgcaagaattggtttattttttaaaccatgtgttgcaaacatacaatggttaattgtgatatttgctcagtacaagatcatcagatcactacacagacttgaggtaattccacctaaaagcaaagagaactgaccccacattaactgagaagtctttacttatttattccctataaacgagccaatatgaagagaaggccttaatgtggttaactatgtaatttttttctgactttttgaaatactgagaagagctcatgactctcccatctcctaattctaccttggtggattttagactgaccacaactcatgggtaaatgagggaagacgaataagaaaccttgcttttttttcctccttgtttttggctggctgcagtggctcacacctgtaatctcatcactttgggaggccaaggtgggaagatcacttgagctcaggatttcaaaactggcctgggcaacatagtgagaccccatctctaaaaaaaaaaaaaaaaaaaaaaaaggcgacaggcggtgcgtgcctgtaatcctacctactcaagaagccgaggtggaaagatcacttgagcatgggaggtcaaagctgcagtgaaccttgattgcaccacttcattccagcctgggtgacaaagcaggacgctgcctcaagaaaacaaaaacaaaaccttaattttttggctattcttttctggtaagaatggtatagagatggggatgaggatggctattgtatgagagagcaaacagggtccaagcagtgctctgggctgtctaaggaccagtagtcagcttaacttctcaaatttccagggaaggagttcggagtggtagaatatcctgggtatgcccaaagcatcaccttgcaaatagcctgtcatgaataatttgtttcatttgttatgactggaaactggctttgtgtatgccagagaatgggggcaggaaagagagattggtgtcttgagctctctgtgcctctggggcagtgatgcttttcctctcatgtggaaggagagcatgactgaaaaggtgcacaaataaggtgtctgtgagagaaattaaccttccagatacagagacacaaccttccccaagaggtcctcattgctctgccttttttccttttttttgcttgttctaccattaataacagaaactgattatgacctcaaaagagaggagaaagcgactctccccaccctagagctagttaaccaccatatcttcctagatatccttgagagcaatgtaacccgtgaactcgttttacctgtgtagcagaccaagccgcagacaaaatccntcagacaccaaattaaagaaggaagggctttattgggcctggagctgcggcaagactcacgtctccaacaaccgagctccccgagtgtgcaattcctgtcccttttaagggctcacaactctaaggcggtccacatgagagagtcgtgatagattgagcaagcagggggtatgtgactgggggctgcatgcacctgtagttagaatggaacagaacatgacagggatcttcacagtgcttttcttatgcaaataaccgattagatcaggggtcgatctttaccaggcccagggtgtgtcaccgggctgtctgcttgtggatttcatttctgccttttagttattacttctttctttggaggcagaaattgggcataagacaatatgaggggtggtctcctctcttacctgcggggagtgagctcaaactccttaaaggagttacctgccttccatcatcagggaagcaggaaatcttgccttccttgttggaagcaagtaaaactcaaaacaaacaaagaaaaaaacagggagttgtacagcaaaataaacttttgattttgaccaaattttgggagatcaggaattctctgaaggagatgctttcagacctcagcaaattgtcctgttggtttgagccataaagttagctcatgctggtaccaaacaccagtaggagatttgtcaaaggtaagaggcatctccactcagaatcccttcgtggttaccaacatgtgaaccttggaaatctgagacaggtctcagttaatttagaaagtttattttgccacggttgaggacacccacccatgacagagcatcaggaggtcctgaccacatgtgctcagggtggtctgagcacagcttggttttacacattttagggagacatgagacatcagtgaatatatgtaagatgtacactggttccctccagaaaggcagaacaacttgaagcagggagggagcttccaggtcacaggtaggtgagagacaaacaattgcattcttctgagtgtctgattagcctttccaaaggaggcaatcagatatgcatttatcacagtgagcagaggggtgactttgaatagaatgggaggcaggtttgccctaagcagttcccagcttgacttttccctttagcttagtgatttggaggccccaagatttattttccttctacatcactgtgggcagctgactaggaaagctttgtaggactggtgggcagtgtgagagcccagtggggggtggtggtcctgtgccaatggtagcaaccacctgtgaggctgagtaaactcatttcccaacctcctctagcagccccagtggagatacagaggaagcagactagcgatacaacccagcctgaagttttgtctggtgagtgtaatggaataaaaatgggaagggtgctgaagagaccagcaagaaaatggttgaagagatggggcacagaaattaagctggatcaaaaaggacggaaaagcagaaagggccgatagagagaggggatatctatgggttcgcgattctgaaaaggacaaatcactggtgctttgagaagagagagggtgagaaagcaggaaggctggaggctgtcatccaagaggcggacatctgtgaacatgattccaagagtcaccagaccatgggggtggccaaagggagtgcctcttctcacctcctactcttaattccttgtactcaagataataagttcccagaagagaagtacccatatttaattcatctgtgtcttcctagcagtactaaaaatattatatgaaaggtatcaaacctttgagaatgtgtgctgctaaattgttaaggatgctggaaaactcaagacgtccctgatcctgagcctgagtatgagcctgtggtgagcccaatgcaggtctccattcagacaaaggcctcagggaacggatgagacctagggacagagatgcatgctggagcagcattccccatccctactgcagctcaggccagctgactgctttatgagtaaacgttaccagggaacactttgcagtcttaacacacatgcccacctgtgaccactgatccctgttgggtgaccactgacatcagagattcgatggcagcaatgaagacaaggctatcctcattaggaaggaaaggaaggaggagggaggagggcaaacgaatctttcctgcttgtcaaccacgtccatctctgttaggtgatttcccatgtgtgactttgtttatctttataataactctgagaggtaggtcttgatgtccacattttgaacatgaggacatccagccaggaagttgagttctggggacatagctgagagggcaaagctacatataaacccctctttgttttttctggcttatccactgagtgccccctgcaatccaccagcccatttgtgaagtgcatactataggtaagttggcacaggaggagtggatgtgggcgattttgtcacagctctccaggaacttacacactggtgaggagggccaggtatgttcctgaccagtcacaatcaaagcaacctcctactaatcagggaggcttggtacctggggaatgctatgttgaaaggttcttttctgggttttaaaatgatgggtctatttccttattcttaagattgctttttttctggctagaacttaaaagaaattttcagtaaaatttcccttccctggcacaaagtgagcttgaaatgaattcccaggtggccttgatactttaaaatattgcctcctataaaatcaacctttagaagaaggaagtcaaagaacatgctagatttcacaaaggttaattccttgaaatccagttatctacaggacaatgttgtcaaagaaaaaattatttggccaggcacggcggctcatgcctataatcccagcactttgggaggctgaggcaggtgatcacctgaggtcaggagttcgagaccagcctggccaacatggtgaaaccccatctctactaaaaatacaaaaaaaattagccaggtgtggtggtgggcacctgtaatcccagctacacgggaggctgaggcaggagaatcgcttgaacccgggaggaggaagttgcagtgagccaagttcaagccactgcaccccagcctgggcaacagagcaagactttgtctccaaaaaaaaaaaaaattcaatgatatttttaaattcatggtaaggaagatttcattcagaaccagcacagaagatataggaaacactgcaatgggactttgcggtgggggagagagattgaacacaactacatatacagcacgggcaaggacatattcatagccaggaagcagagcaaagatcagtggatgcgaaattactaagaggaaacatgaaaaataagggagcttctgcctaaacccacctaaccggatccttgctgaagacaggacagggtgattggacaccactttggggatggtggaggatggggaatccagtgagatttcaagggtgatgcgatattgaacatacaaagttcttgctaaaaaaggattttacaagaaagtgtacaaatgtgcctgggacaaggtgcaggagcccgacggagatgtggtccagcagagaatatgtgccgagatgataggtgagttctctgacgaaggatatatgctgatccagccagggtgaaatgctcagagaaagcacggaggggctatgtccgttgccccagtctccacgcggtcaaatctgatcccgttgtgagtgtggccgtttgtagaaagcaatcagggggggtccctccccaatatatattttttatannatntgagacaggttctcactaggttgcccaggctggtcttgaattcctgccttcaagtgactctcccaccttagcctactgcatagctgggattacaggcacaaaccactgcatgcagctaactttgcttctcattccagcactttttattccactgattatatgtatatgtatatctgcatcatctctctctctctctctctctctctctctctatatatatatatatatatggaaatatctctctctctctctatatatatatatggaaatatatatctcagtctctcctatcctcctttaatcagttttgctatcctgtcaattcccccaacgagtgtgatgttgtgaaatatatatttgttcttcatctcctgtttcctgacatacagcttttaaaaacccttggaatctctggaataataagagtgtcttttgcatgctaatagatgactgctggctggcagccccaatgcagtagcttcatgatggggtttgtcacaggaaagaccaaggcaggattggagacttgagactgttagccccactccccaaccactggagggagtggaggggctgaaggttgtgtcagtcaccaatggccaatggttcggtcaatcatgtgtatgtaataaagccactcttaaaaacccaaaaaggacagggtttggaagggctcccagatagctggacacatgaaggttcctggagggtggtgccccagaggggcatggaagctccacaccccttctcacatgctttgctctgcgcatctcttcatctggtgttcatctgtatcctttgtaatatcttttagaataaactggtaaacttaagtgttttcctgagttctgtgagctgctctagcaaattcacggaacccgagggaagcaaacccagatttatagccatcagtcagaagcataggtgacaacctaccacttgtaactggcacctgaagtgggaggcagtcttgtgagactgagccctcaacctgtgggatctaacgctaactccaggtagatagtgttggagtgaattaggacacccaactggtgtcggctgctggaggactagtggtgggagaaatccccaagcatttcggtgactagaggtcacagaagaactcagtgttgaggtgttgtgacagtatggtagggaaaactgcgtctggttttttccttttacaatcagttaaatatttaacacaagtctactgtatattagtaaaagggttacattttttaatgtcttgacagttgcactttgacaacttccatatcaatcactttttttcgtgtccgtttggaaccaaaatcacttgggataccatgaaccaggctgcagcgtattccccaggccttgaaagcttggaggccattttgccagccntaatccctgtgaataccaggcttcgtggatttaaaaaatagacttgaggccaggcctggtggctcacacctgtaagcccagcactttgggaggcagaggcggatagatcacaaggttaggagttcgagaccagcgtggccaacatggtgaaaccccgtctctactaaatatacaaaaaaaaattagccgggcgtgatgttacacgccagtagtgccagatactcaggaggctgaggcaggagaaatacttgaacctgggaggcagaggttgaaatgagtcaagatcgtgccactgcactccagcttgggcgacagagtgagactcagttttcaggggagttaaaacaatacaaaaaaagaaaaagacttgaacaatgaggctccactggatggatttaggggaattacaggaagcaggacctgacggtgcaatgccacactccacctgtccagaattggacctcaccaagggaggtctgtggggacagggagaggccctctgcctccaccccctcctctactccccaaaccctgagtcaggctgaatgtagtaaacctggaacagaaaagttcagtttggcaataggtatctgaaggactccaggtgcttctcccttgattcaaaattttacttataaaaaaaattataagaaaattctacttaaaagaaataatcagggaggtacaacaaattgtacttttttttttttttttttttttttgaaatggagtctcactgttgcccatgctggagtacagtagtgtgatctcggctcactgcaacctccgcctcctaggttcaagtgattttcctacttcagcctcccaagtagctgcgattacaggtgtgtgccaccacacccggctaatttttgtatttttggtagagacggggtttcaccatgttaaccaagatggtctcgaactcctgacctcaggtgacccacctgcctcagactcccaaagtgttgggattacaggggtgagccactaagcccagccattgtacatattttgtgggtatttactaaaacattattcaaaatagtaaaaaaaaattgaaataaactggggactggttaaataattttgggtacaaccacatgatggaatactatacagccattaaaaattacattgaggccaggtgtggtggctcatgcttgtaatcttagcactttgggaggccaaagtgggaggattgcttggacccaggagctcaagaccagcttgggcaatgtggcaaaaccctgtctctaaaaaaaaaatacaaaaaaaattaaaaagctgggtgtggaggcacacacctctagtcccagctactcaaagggctaaggtgggaagatcacttgaaccggggaggtcaaggctgcagtgacccaaaatcgggtcattgcactccagcctgggcaacaaagcaagaccctgtctcaaaaaaaaaaaaaatacattgaagaatatcttacggtatggataaatattcattttacagtgatagatgcaaataaaagcaaattacaaaatatacagtttaattccaactttgatactacatatgtatatatgaatacatgcatatgttatgtatgtatatgtaaatataacaatatatgttctatatatggatattatatatttacacatacatacacacatatataatatcttctctagagagcagaaagagagtagacagataatgaagataggatacaactccagtccagctcaacctaggggacttgttttaaagcctcaggagagagaagttgggactagaaagcaaggcagctatttgtaagcatctttgtgtttcatgctattggggtgggaaacaacagcacaacttttgaaagcccctttctactcaccccacaaactgcagagcagctttaggaccctcagagttcaagaagaccatttgcagagtagaagaagtaaaaacatgtatgaacttgaccctgagctcatggactgtgccatgagggaaattcctaaaacagcaggagaggccctggaggaaggcagaggccctgcatcagcaagtccaggcaaaagcctgcattccatagatgctcatctctctggctggtgaggtctaaagacgtttggtctcaatattaagtctcgtgagagaggtcacaaacccagtcccttggccacaaaaggaaataaattctggcttgagacattagggaggaacagggcaaggggaggttcaagaaagttttaatggatgagatgatatttaagcaaggccctggaaaatgagaatttcaaccaatagccatatggtaggtcagaaagcaaagataaggagggggcaagtgcaaggggcaacatcagatatgaccagggtgtcgtggggcatggctgatggagaagaagattagactggagtttgggaatgccacagtatcgaggttggatttaatcctatgggtaataaagccaactgttcaacccccaacccacttgcaatatggctccaaaatagcaggtgtttgataaaatgactacttttactctactattccctccctcttaagaagaaaaagaaagtggaggctcagagaaaggcagtggcttgtcccaatcacactatgatttggccacaaaacaagaacgaaatgttacacccaaaaatgctgcctccacctcccttccttgctttcctccctgctggactacagactatctcaagagtgacgtacaccatcagggcttcagcttttccccgaaacaatgccaaaatattagccatacgtcactgtagtaagagccctgaattgggaatcccagctttgacgcagacatgctgattgactctgtgaccattctcttcacttctccactctattcttccccacctgtaaagtgaggtcctttccagttataaaaacagatgatgctattgtcctgttttgtatctaatcttgctgtgttataaaaaaaaaataaggctctgtacattcatcttggccaattcccttcttatctctacttcccacagcccctttttctacagaaaaccagcattgttcttctggatccatctcttaagaaagcgctttgcctccccggttatttaggtgataagaagtgtcctagatgacagccctggaatgggctggaggcaacaaaaaagcaagtgaaatagacagttacagcgacgacaataataacaaccaacacctctcactaaagagaaagaaataaaaaagaaaattaaaatctgccgcaatgcccacacagtcattgaataactgcatgtgtacagcacttggttacttttacatacttcatattttagccttcatagcagctcacaggggtggatttaatttttagtccaactcctgtcacggtgcctggcacaagtataataaatgttctgtgaataaatgaccctctttttagatgaggaaatcgaggctcaaggagaacaagcaatgtaatgtccccctcctgttcagccatctgcctttcacgccactgaatgcagtagtcctcagtgccctgaacttgaccctcttctgcttttcggactggtccttctaatcccgttgtgactcactacaccacctctcctgcatatgacatctacattttaaaacaaaccgtatggaaataacacattagtcggcttgttcccccacccccgcaaaaaaaaaggcctctttataacagaaacttctcaggctggtaggggaattttattcccccatttatggtagaaaggccctaaccttggacctcacgccatagctattcacatgggggaatgatgaataacatggggagcagcatgtaaatatcattgagccgtagtccagacctataacacatcgggggagctgcatgtgcctgtcgagatctgggggaggaacaggaagatcaagagttctgtgtaggacatgttaagttgaaggtgcttacaggatagccagatgaagcatcaggtgtgcagtcaaagatatgagtctggagcagcacatcctaagtcacctcctgcaccaacacagaacttccaggccactcacttgagctctcccaaatagtttccaagtgtcattatgttaataacctatgagcttgaacaccagattcaaaccccactgcatggcttttaaagaccatctcaagggcttgacactccagggagccaactaaagatgcctggtcctaccatcaacctccaccccattttttatagaaaatgtttctacctgtcctaaggcagggtcctgccccactcccaggcccctttagatccccaatattcctcctccctgaaccaaaaccctcatcatcttccagcatgggtggggcctccattcttgcttctgctcccctgagcagaagcaagtttctcccaacttgacctgattctcctcctaagtaccagtcactgctttgtttctggaatgagagaaaaagacagagtgagagagacaatccagaactcttgctcactcacagctaggctgggcatctgggaggatggctgtgtccatgggaacctgggaaaagccacacccttggcaccctggtcacccacctgtctccctggcagattccgcactgctctcttgcaccctctaccagggctaaccggcctgctcactctccccagcatgtcttcccacgcccactctctaattattacattcccttcacataaactgcccttctctcccaatcaccacatgttcacttcccacccagctgtcaaagtctggctcaacctcattcttgaaaaggaaaaaacaaacaaacaaacaaacaaacaagcaaaaaacctatgatggattaagaacacacttcattccaggaacatgcttatctcctctaactctcacaacaactacagcaggtaggtgttatcacacccatctctcaggtgagaaaacaggctcaacgagtgcaggaggacacagcaagtcagtgacaaagcttaaattcaagcccaagcctgttggcaaccaacgtctgtacccttgatagctacctcatttaccaccaaatccagtggcctcaggcctggctgcacactgggatcacctggtgcccagaccacatcttagaccagtcatacagaatctcttgggctgggatcctccacggtacattttaagggtccccaggtgagttccaccatggacccagaattgaggacccaataccgtataccatctccttcttcatctcttctaaggcatctcttactcgctgtgcactcccataccactttgttcaatcatccaatcattcattcattgagtcagttagtcaggagctactcactagtcccctgccaggtcctagtcatgacatagggctctggggaccaacaagaagcaggacccatgcctcctgctctcatggagcttgctctgcagcagaggaagcagtcagtgagatgtagcaaatgtgaaatgtgcacagatgggaaaagcaaaactttaaaacttttaggacaaaatacacaagaaatctttgcaactttgggacaggaaggaacaacattccttacacatgacaccaaaggaatcaaccataaataaaaaggtgatcaatttgacctcatttaagtgttaagcttttttcattgagagacaccattaaaaattaaaaatacatgccacaaactgggatacaatatttacaacacttatgtctcacaaaggattagttttcagaatatataaagaactcccggccgggtatggccgcgcacgctggaatctcagcactttgggaggccagcggatcacatgaggtcaggagttcaagaccagcctggccaacatggcaaaactccgtctctactaaaaatacaaaaattagccaggcatggtggcgggcgcctgtaatcccagctactcaggaaactgaggcaggagaatcacttgagcccagaaaacagaagttgcagtgagctgagctcacatcactgtaagcctcggtgacagagtaagactgtcaaaaaaacgaaaacaaaaacaaaaactcctacaaataaataagaaaaaaatagcccagcaggaaaaagtatatacatttcataaaagaataaatacattctgtcagttttctaacatatattttttaagagtaaatacaaatggttaggaaacattttttaaaatgcccaacctcattaaaaattatagaagtgaaaattaagccacaataagatacgattttataccaaatacagtgtcaacactttgcaagtctgacctcaccaagtgttaccagacgtgtgcactgacgtggctgctgagatactgatggtgggtgtgtaaatctgtactacaaacaattgcaataaaatgtaataaatatacaataggtggagcaggaagtgacctgcaaccatatagcagatagggcaggaaaaagcctatgaaagctgacatcaaagggataagttccagttacccagctgaagggaaggagggtgtttcagatagaggaaggataagcatgacctattcaaggccagtgaaagaagcgtgcaacggccaagtcaggagaacctgaaattgtgtcaaagagcttggatgcaaagagccgtgggagactattgggggttttaagcagggatataatattcattcaagcatgcagtaaaaggtcactggcacctgccatgggccaggactcgggctctacatgattgcgtctgttttggaaatatcaccctggctgtgagatgaagaacaggtaggagggtcacaaaacttgaagcagagagactgttgaggaagtaagctgtttttgtgtggactgtggcaatcacagaggcagaggatataaatgcacagagacacaaggcatgtgggaggcagaaggaatcaaatacaatgagtgatcagatgtggggttagagtggtgagtgagaagacatactcaaggtgacacgcccaggtatctgggtggatggtaagacattcatggactaggatcgaggaangaggtggggaatgggaccatacctgcagtttataaggggtggacgagggaagattatgcgggagactgagagaggaatagacaaaggaatcccggtgcagtattacagaaactggggtgggagggggttgtanttcaaaaaggaaagaaaattgtcaaatagtatgaaatgctgcagagaaactcacggattttttttttaagcttagaattattcattgactatgtgaataagaataacttttatgaaagaagttttgcttaagtagtaggaagaagcaaaattgttgagggctgatgagtgggaggagaagtaattgaaggcactctttcaagagaaacaaagcagaaggtgaggagaatactaatgaaggagttacggccttcactattttgttttgctttagataagcaagacttgagtgggtctggtgaggagaaacaagtagagtacaaagttaaaggagagacagacagagatagagatagggacagagagagagacagagacagagcacaaaagagcaaggtccctgagaacacgggccttctgtttaaaccccagccagatgtattgcaattcaattccagtactaaccacccagagtttgtgtagactctacaagttaaagagcatggtccccaacaagactgcttctacgtcagatgccaggcacacttcaggggtccccaagccactcatgttttttgaatgactgccataagttcaaaaattcccacaattctctcagattcaataactgggtataaccactcatagaactcaagaaaatgctatcattattattacaattttattataaaggatacaaatcagaaggactagccaaatgaggagacacatagagagaggactagtaaaaaacagagcttctgcgtcctaccttcaaggaatcaggatgcaccaccctcccagcacatcaagtgctcatcaaccaggaagttcctctgagctccaatgtccagagattttagggaggattcattacataggtatcattgattaaatcattggccatgtacttgaactcaatctccagtgtccctcttctccctagaggtctgaagggttggctaatatcatgtggctcaaagccccaactctaattacctttttggtcttttcagggactagaccccatcctgaagctatctacaggccctgccatgagttagctcattaacataacaaagacacttatattactcagaaaattccaacagttttagaagctccatgtcaggaacctgggacatagatcaaattctttttttttttttttttttggagacagggtcttgctgtgttgcccaggctagagtgcaacgacagatcacagctcaatgcagcttcaacttcccaggcttaagtgacctttccaccttaaccttccaagtatctgggaccacagaaaatggctaattatcctggctgatttttaaactttttttttttgtagggatgggatcgccctgtgttgccaaggttggtctcaaactcctgggttcaagcaatcattctgccctggcctctgtgatggttaatactgagtgtcaacttgattggattgaaggatacaaagtattatttttgggtgtgtctgtgagggtgttgccaaaggagattacatttgagtcagtggactgggaaagtccaccctttcccagtggactgggagacccaccctcaatccaggtaaacacaatctaatcagctgccagtgtggtcagaataaaaggaggcagaagaacagggaaacactagactggcttagtcttccagcctacatctttctctcatgctgaatgcttcctaccctcgaacatcagcctccaagttcttcagtttttggactcttggaccttcaaccacagattgaagactgcagtgttggcttccctgtttttgaggttttgggactcagactggcttccttgctcctcagcttgcagatggccaattgtgggactttaacttgtgatcatgtgagtcaatattccttaataaactcagatatatatatatgtatcagacatatatatatatcctattgtatattatatacagatatataatatcctattatatacagatatataatatcctattatatacaggtatatatatatatatgtatcatatatatatatcctattggttctatccctcttgagaatcctgactaatacagcctcccaaaatgctgagattacaggagtgagccacagccaccatgcccagccccaaattcttaattatacaacaatgggtccagagatcagggcctgggtaggatgcagcaataagaaaacagatggtggatggggacacatgttggaagtgtggcaggacatggctgagggaactcataggatggtgtctattttcatggctgagtgtgaggaacagcataaggtcaaaatttcaggtcaatggtgagttttttaaattgttgctgtgaaccccaaaaatctgacccaggtctcagttaatttagaaagtctatttttccaaggttgagaacacccacccactcacgacaagagcatcaggaggtcctgaccacatgtgcccaaggtggtaagagcacagcttggttttatatattttagggagacgtaagtcatcaatcaatatatgtaagatgtacactggttctgcctagaaaggcaggacaacttgaagcagggagggggcttccatgtcacaggtaggtgagagacaaacagttgcattctttgagtttctgattatcctttccaaaggaggcaatcagatgtgcaattatctcagtgagcagagggatgactttgaatagaaagacaggcaggtttgccctaagaagttcccagcttgactttttcctttagctttgtgatttggaggcgccaagatttattttcctttcacatttccccccctttctttttaagaatcttttaaagaaagcttttaaaaagaaaatgagtctctggtcccaggtttcatctgaattctcgaggggaggatggtttatcctaaacgggtggttctgaattttgagaaagtgcattgtacaaaagccatacgaatgaggaagaattaagggccagaacaaaacaagaagatgagggaaagtttggaacttcttagagactggctaaatggttgtgaccaaaatgctgatagtgatacggacaatgaagtccagggtgacaaagtctcagatggaaatggggaatttgttgggaactgggcaaaggtcacccttgctatgactcagcaaagaaattgggtgcattgtgttcatgtcctggggatctgtggaagtttgaatgtaagagtgatgacttacggtagggtatctagtggaagaaacctctaagcaacaaagtgtgttgcttagaaatttctttctttcttttttttttttttttgagctggagttttgctgtgtcgcccaggctggagcgcagtggcgcaatcttggctcacttcaagctctgtctcctgggttcatgccattctcctgcctcagcctcccaagtagctgggactacaggcgcctgccaccatacctggctaattttttagtattttagtagagacgaggtttcaccatgttagccaagatggtctcaatcttctgacctcgtgatccacccgccttggcctcccaaaatgctggggttacaagcatgagccaccccgcctggcctgcttagaaatttctaagccaggatatggcctgtctgcttctaacagcctgtgctcaggggtaaagaaatgacttaaagttggaacctatgtttaaaatggaagtagagtctaaaaatttggaaaatttgcagcctggccttgtggcagagaaagaatccaagtaggctgcagagcaatcattgctagagagattagcatgactaaaagggagccaagtgctaatattcaagacaatgttaaaaaggccttgagggcatttcagagatctatgaagcagcccctcccatcacaggtgcagaggtttggtgcactaggcccagaggttttatgggccanngccagggccacactgctatgcacagctttgggacactgctgcccgcatccaggccactctgctctggctccacccttggctcaaacgggccaagatagagcttggaccactgctcccgagggcacaagccataagccttggtggtttccatgtggtgttaagcctgcaggtgcccagaatgcaagattgagggagcttgggcacttccacctaaatttcagaggatgtgtcagaaaccctaggttcccaggcagaagcatgatacaggggcagagcccttgcagagaacctctactagggcaatgccaaaggaaaatgtggggttggagtcctcacacatggtccccactggggcactacctggtgatactgtgggaatggggctgctgccctccagaccccagaatggtagatgcactggcagctggcaccctgagcctggaaaagctgcaggcactcaactccaacccatgagatcagccacatgggctactcccagggaagcccacagaggcagggctgtctaaggccttgggagcctaccccttgaaccagcttgcaggacatggaatcaaagattatgttgcagctttaaggcttaatgttttccctgtcaatttcaggcttgtgtgggacctgttgctttttttttttttttttttttttttggtcacaggtgtttgaaccagaacaattccatcttgaataggggctgggtaaaataaggctgagacctactgagctgcattcctaggaggttaggaattctaagtcacaggaggagataggaggtcggcacaagatacaggtagcgaagacctcgctgataaaataagttgcagtaaagaagccagccaaaactcacaaagccaaaatggtgatatggtttggctctatgtccccacccaaatctcatctcaaattataattcccataatccccacatgttgaggggaggacctggttggaggtgattggattatggaggcaatttcccccatgctgttctggtgatactgagtgagttctcataagatctaatggttttataagtgtttggaagttcctcctacacacatgctcacactctctcctgcagctttatgaagaaggtacttgctttcctttctgccatgattgtaagtttcctgaggcttcccagctatgcagaactgtgagtcaattaaacccgttttctttatacattaccagtcttgggcagttctttacagcagtgtgagaactgctggcgatgagagtgacctctggttgtcctcactgctcattatatgctaattataatgtattagcatgccaaaagacactcccaccatgaccccaacagtcatgcctgtgccggtctcagcaccatgacagtttacagatggcatagcaacgtctaaaaggtaccccatatggactaacaaggggaggaaccctcagctctgggaagtgcctacctcgttcccagaaagcttgtgaataatccactgcttgtttaacatataattaagaaataactattaagcatccttagttcagcagcccaagctgctgttctgcctatggagtagccattctttattccgttactttcttaataaaattgcttttactttactgtatgtactcgcctggaattctttcttgtacgaggtccagagccctctcttgggtctggatcgggacccctttctggtaacattttgaccaatttctcccttctggaatgggaatgtttacacaatgactgtatcacttttgaatcttggaagtaaataatttgtttttgactttacagcctcataggtggaaggaacttgacttgaatttcagatgagactttggactttgggacttttgggttggggctggaatgagttaaaagttggggggattattgggaaggcacgattttattttgcaatatgagaagcacatgagatttgggggaccaagggtggaataatatggtttggatgtttgccccctccaaatctcacattgaaatgtaatccccagtgttgaagtgaggcctgctggaaaatgtttggattacaaggctgtcgagcacattggataagacgtgtaggnccccgcagctcgctggttaattctgtggctcctgtgaccactattatagcaccaggtctatgaccaggagaattagactggcattaaatcagaataagagattttgcacctgcaatagaccttatgacacctaaccaaccccattatttacaattaaacaggaacagagggaatactttatccaactcacacaagctgctttcctcccagatccatgcttttttgcgtttattattttttagagatgggggcttcactatgttgcccacactggactaaaactctgggcctcaagtgattgtcctgcctcagcctcctgaatagctgggactacaggggcatgccatcacacctagttcatttcctctatttaaaatatacatggcttaaactccaactgggaacccaaaacattcatttgctaagagtctggtgttctaccacctgaactaggctggccacaggaattataaaagctgagaaattctttaataatagtaaccaggcaacaccattgaaggctcatatgtaaaaatccatgccttcctttctcccaatctccattcccaaacttagccactggcttctggctgaggccttacgcatacctcccggggcttgcacacaccttcttctacagaagacacaccttgggcatatcctacagaagaccaggcttctctctggtccttggtagagggctactttactgtaacagggccagggtggagaattctctcctgaagctccatcccctctataggaaatgtgttgacaatattcagaagagtaggaggatcaagacttctttgtgctcaaataccactgttctcttctctaccctgccctaaccaggagcttgtcaccccaaactctgaggtgatttatgccttaatcaagcaaacttccctcttcagaaaagatggctcattttccctcaaaagttgccaggagctgccaagtattctgccaattcaccctggagcacaatcaacaaattcagccagaacacaactacagctactattagaactattattattaataaattcctctccaaatctagccccttgacttcggatttcacgatttctcccttcctcctagaaacttgataagtttcccgcgcttccctttttctaagactacatgtttgtcatcttataaagcaaaggggtgaataaatgaaccaaatcaataacttctggaatatctgcaaacaacaataatatcagctatgccatctttcactattttagccagtatcgagttgaatgaacatagaaaaatacaaaactgaattcttccctgtaaattccccgttttgacgacgcacttgtagccacgtagccacgcctacttaagacaattacaaaaggcgaagaagactgactcaggcttaagctgccagccagagagggagtcatttcattggcgtttgagtcagcaaaggtattgtcctcacatctctggctattaaagtattttctgttgttgtttttctctttggctgttttctctcacattgccttctctaaagctacagcctctcctttcttttcttgtccctccctggtttggtatgtgacctagaattacagtcagatttcagaaaatgattctctcattttgctgataaggactgattcgttttactgagggacggcagaactagtttcctatgagggcatgggtgaatacaactgaggcttctcatgggagggaatctctactatccaaaattattaggagaaaattgaaaatttccaactctgtctctctcttacctctgtgtaaggcaaataccttattcttgtggtgtttttgtaacctcttcaaactttcattgattgaatgcctgttctggcaatacattaggttgggcacataaggaataccaacataaataaaacattctaaaagaagtttacgatctaataaaggagacaggtacatagcaaactaattcaaaggagctagaagatggagaaaatgctgaatgtggactaagtcattcaacaaagttttcaggaagcacaaagaggaggggctcccctcacagatatctggattagaggctggctgagctgatggtggctggtgttctctgttgcaaaagtcaagatggccaaagttccagacatgtttgaagacctgaagaactgttacaggtaaggaataagatttatctcttgtgatttaatgagggtttcaaggctcaccaaaatccagctaggcataacagtggccagcatgggggcaggccggcagaggttgtaaagatgtgtactagtcctgaagtcagagcaggttcagagaagacccagaaaaactaagcattcagcatgttaaactgagattacattggcagggagaccgccattttagaaaaattatttttgaggtctgctgagccctacatgaatatcagcatcaacttagacacagcctctgttgagatcacatgccctgatataagaatgggttttactggtccattctcaggaaaacttgatctcattcaggaacaggaaatggctccacagcaagctgggcatgtgaactcacatatgcaggcaaatctcactcagatgtagaagaaaggtaaatgaacacaaagataaaattacggaacatattaaactaacatgatgtttccattatctgtagtaaatactaacacaaactaggctgtcaaaattttgcctggatattttactaagtataaattatgaaatctgttttagtgaatacatgaaagtaatgtgtaacatataatctatttggttaaaataaaaaggaagtgcttcaaaacctttcttttctctaaaggagcttaacattcttccctgaacttcaattaaagctcttcaatttgttagccaagtccaatttttacagataaagcacaggtaaagctcaaagcctgtcttgatgactactaattccagattagtaagatatgaattactctacctatgtgtatgtgtagaagtccttaaatttcaaagatgacagtaatggccatgtgtatgtgtgtgacccacaactatcatggtcattaaagtacattggccagagaccacactgaaataacaacaattacattctcatcatcttattttgacagtgaaaatgaagaagacagttcctccattgatcatctgtctctgaatcaggtaagcaaatgactgtaattctcatgggactgctattcttacacagtggtttcttcatccaaagagaacagcaatgacttgaatcttaaatacttttgttttaccctcactagaggtccagagacctgtctttcattataagtgagaccagctgcctctctaaactaatagttgatgtgcattggcttctcccagaacagagcagaactatcccaaatccctgagaactggagtctcctggggcaggcttcatcaggatgttagttatgccatcctgagaaaggccccgcaggccgcttcaccaggtgtctgtctcctaatgtgatgtgttgtggttgtcttctctgacaccagcatcagaggttagagaaagtctccaaacatgaagctgagagagaggaagcaagccagttgaaagtgagaagtctacagccactcatcaatctgtgttattgtgtttggagaccacaaatagacactataagtactgcctagtatgtcttcagtactggctttaaaagctgtccccaaaggagtatttctaaaatattttgagcattgttaagcagatttttaacctcctgagagggaactaattggaaagctaccactcactacaatcattgttaacctatttagttacaacatctcatttttgagcatgcaaataaatgaaaaatcttcctaaaaaaatcatctttttatcctggaaggaggaaggaaggtgagacaaaagggagagagggagggaagcctaatgaaacaccagttacctaagaccagaatggagatcttcctcactacctctgttgaatacagcacctactgaaagaactttcattccctgaccatgaacagcctctcagcttctgttttccttcctcacagaaatccttctatcatgtaagntatggcccactccatgaaggctgcatggatcaatctgtgtctctgagtatctctgaaacctctaaaacatccaagcttaccttcaaggagagcatggtggtagtagcaaccaacgggaaggttctgaagaagagacggttgagtttaagccaatccatcactgatgatgacctggaggccatcgccaatgactcagaggaaggtaaggggtcaagcacaataatatctttcttttacagttttaagcaagtagggacagtagaatttaggggaaaattaaacgtggagtcagaataacaagaagacaaccaagcattagtctggtaactatacagaggaaaattaatttttatccttctccaggagggagaaatgagcagtggcctgaatcgagaatacttgctcacagccattatttcttagccatattgtaaaggtcgtgtgacttttagcctttcaggagaaagcagtaataagaccacttacgagctatgttcctctcatactaactatgcctccttggtcatgttacataatcttttcgtgattcagtttcctctactgtaaaatggagataatcagaatcccccactcattggattgttgtaaagattaagagtctcaggctttacagactgagctagctgggccctcctgactgttataaagattaaatgagtcaacatcccctaacttctggactagaataatgtctggtacaaagtaagcacccaataaatgttagctattactatcattattattattattttattttttttttttgagatggagtctcactctgttgcccaggctggagtgcagtggcgcaatcttggctcactgcaagctctgcctcctgggttcacgccattttcctgcctcagcctcccgagtagctgggacaacaggcatgtgccaccatgcccagctaatttttttgtatttttagtagagatggggtttcactgtgttagccaggatggtctctatttcctgatctcatgatccgcctgccttggcctcccaaagtgctgggattacaggcgtgagccaccgcgcccggcctattattattattattactactactactacctatatgaatactaccagcaatactaatttattaatgactggattatgtctaaacctcacaagaatcctaccttctcattttacataaaaggaaactaagctcattgagataggtaaactgcccaatggcatacatctgtaagtgggagagcctcaaatctaattcagttctacctgagtaaaaaaatcatggtttctcctccatccctttactgtacaagcctccacatgaactataaacccaatattcctgtttttaagataatacctaagcaataacgcatgttcacctagaaggttttaaaatgtaacacaatataagaaaataaaaatcactcatatcgtcagtgagagtttactactgccagcactatggtatgtttccttaaaatctttgctatacacatacctacatgtgaacaaatatgtctaacatcaagaccacactatttacaactttatatccagcttttctgacttagcaatgtattgatgacattatgcatgcttagacctccgtattctattctcggttataacacaatcacagtgatttgtcatatctttccaggatttgttaatttcacttcttcagctgtttcccccttgttggctggaactgattttctatcttctgggagaatcttcagcaagccaactcaggatttgttgggtgcattttgtcaagtctaggacccaggctctgggtgactgatttcctctaattaccgagcaatgtaaaatgaggaagtctgattgtgtaaaggtgttaaacttttgtgtgacggcaaaactttaataccatgaatagagattccagaattttccaacttctaacgggattcctttcactccctgacattagaatgttagaaaatctaccacaaaacatctgtgaggctatcctacaaggcccgtttttcaaaataggtttttacaaggattgctatttgggatgatagtttcagaaaggcgctatcaaagttaattgatgatgtgtgcaagctgaaagttatatgttagaactagcagtgatttcaaaaatatcccttttaggctttttgctaatatatctgctcattttcaaagttcccaatattataaaactttttaaagcagaaagaagaaccctccatttctgctggccccttccctgttcaactaaaaagtattttcccaggcaatgctatcccaggactcacactccatccatccatcacctaccataagttctttgaagggctcattctgagcgcttcctgagtgcctgggatctgttatttctctccatttctgctgctgcatggtagtccaagtcctcctcccttttcccctaggccatttgaatcatctgctaattggttttcctgattgccacggaaacttcctccatcccttcctcacatatcagccacagaagtatctccaaaaagcaaatctggtgacatgaagcccttgcacaaaacccattcattactggttccacacctcctttgtggataagttcaagctcctgagtgtggcaagcagggcccacctggaatcccctgccctcctctcctatcccacgcatcaatctttcctgtctatttgcagttccttgaatgtgatattctttctagtctctgtgcttttgcataacctgttcttcctgactggaaactccttctcctccttgtagtttggctaatttctagtctttcaagactcagctcatgcttcaccccctctataacaagtcctttcccaagctgggtggtggatgctcctctgtgctgtgtgagtcttgaacatcctcagcaaacctcagctttgtttgcttgtctcccttgctgtcaatgcacctgattcagggctggcatatactgttcacctccatgactggctcatggtggtgctccgtgaatatcatccacccaaacggatgagagctaccatgccatcacttgtgacttccatctggagctaacctcccccgacaggaaagcgtttccttaggaaagaatatctttgggttaaatagaagtagagactcaccagaagcactatgtccagctcagaatgaactgctcagtaagcagccttgtcaatgaggaggcagcaggccagccccagaggcctcaaagtgggagagtagagaagcgcagttcctgccacaaaggcacagtggacaccttgctcccctggctggctggaagcagatggtgtccacctgcttccatgggaattctgcacctttaataaagttttatgggacaggaaggtgactggcattgacattgtaacgaggaatgggtggtgccacctttgctgtgtcttaccagaaatacctgtggcaggtaaatttctagagagaccctcccatttctcccatatagcaattttgaaatgtttcctgagggctttccaaattcatctgggaacataggagttccagaaagatgaaatcaaaggtgatggtatgccaaagaaagtagcttttagaatgacttacattagccattcatccattcagcacaccaggcattcagtttgaggggtgtgtgtgtgtgtgtgcgcgcgcgcgtgcgtgcatgagtgcatgcgcgcgcgtgtacataggggaagggaaacaaaacaaaagtacacaagacatgatagttgtcctcaaggagtttttgcaaatgttcacaatttaagagaatatgctgtgctgtggctggtgtataaaccaactgctagggagaggccttccacacacacttggggcaaatgcgacctctaggactgccagtggaatctgggcatgctgtttgtggtcgataaaccctggtcccttgatcagggacctatgtttacttttcctctccctggaagtcttcattagtgggcatccagaaggtcttgcacagggcagagggaggcacaaagacaagagtttgaaaccagcctggacaacaaaatgagtttctatctttacaaaaaaaatttttaaaaaattagccaggtaggattgcatgtgcctgtagtcccagctattcaggaagctgaggcaggaggattccctgagaccaggaattttgaggctgcagtgagctattaagttggcgcaaaagtaatcgtggtttttatcattaaaagtaatggcaaaacttttaatgacaaaaaccgtgattacttttgcaccaatttaatatgattgcacgactgcactgtgctccagcctgggcaacagagtgggaccctgtcacaaaataataaataaataaaatgtaaacatgtaaaaaaaaccccaaaaacaaaaaaaatgggtgttgagacccctgaattgaggaataataggaaggagtgtgattctgtgtgtgcatgcatgggtgtgcaccctcagtgcctgggtggcttaccctgggctagttcaggtggcaaatggttttcctccagctgggctaccaccatcttcccccagggcctgtccatgtatttggtggcaagatacctatggactagagtccctcctcagaggaaaggctcctcccatttctctggctttcaggtagtagtccatgacttcaacaggtccccactgcaatgttatgggttagtttaggtggggtctcctctgagagcctcccatagcccaaaaggccctgtcctagctggcactgcatctccctcttcccagctctcagcctttctctttgctcatcccactccgcacaggctttctgcctgatccttggatgtgtcaatcctgcccctaagggatgcaaggcaatttgtccttttattattaagatctctcctgaggccacgtgtggtggctcacacctgtagtcctagaactttggtaggccaaggtaggagaattgcttgagctcaggagttccaggctgtagtgaaccatgattgcaccattgcattccagcctgtgtgacacagcgagaccctgtcttttttctttttttttttgagacagggtctcgctctgtcatccaggctagagtgcagcggtgtttttctgctcactgcagcctcaacctgcacattttttgtagagacggtgtcttgctatgttgcccagagtggcctcaaactcctgggctcaagagatctttccacctcagccttccaaagtgctgggactacaggcgtgagctaccgcgcccaacaaagaccctgtcttaaaaagaaaacaaaaataaacaactccctcaagtcttttttttttttttgagacggagtctcgctctgtcgcccaggctggagggcagtggcgcaatcttggctcactgcaagctctgcctcccgggttcacgccattctcttgcctcagcctcccgagtagctgggactacaggtgcccgccaccacgcctggctaatattttgtatttttagtagagatggggtttcactgcgttagccaggatggtcttgatctcctcaccttgtgatccgcccgcctcggcctcccaaagtgctgggattacaggcatgagccaccgcgcccagccagacctcttgagtcttaaactcctctgtagttccagccaccctttagcacatgactctgttaattttgttctcactgtctgaaatcatctcctgtccactcttgactgacaggtctctgcactagcccactgcttaatcagagtaggtccctgtcaacttattcatattgtgtccccatgccagtgtggatgattaaaattgttgagtggaggctgatcagatgagccatctccttccaagtcctcacttgctggctcctgtcttagttttagtccccattcttcaaagaacgtgagccctggaaagtattttagtcatttagttcagtgcctttggatgggaggatcacatccctgggtcccgtcctgcagactgttttgctctagctgactaggcaggattccctgccttctctcacttcggcatgggacttccttctgaaattgctgctcagtcaagagaatgaccttccccaacataatcctactccacagggacttaaaggtgtgtcagagatctcttgctcatctttctggccaggtgccaacgtcagtttatagccaagggacaagactagttagcagatcaggcaggtcttagaccccagcgtaagtgccagacttctagctgcagttgttcctgcccacactgggcgttcaggtggagagagggcatggcactacactgagctctcggcgaaacccaggactctgaaatctcggtgtcagccacaggccactcttttcagcaggacttcagtcagtcctgtcactaggctgtcgagcacatggtaggctttaccccaaggagtgtgcttgctgatagcatgtgtgangggacgaggagtaaataatttctgccttcaagaaattgcaaactagtaatggagataaaatcaacagaggaacaattagagtataaggtaaaatctaagggccataagagaggagaagaagtatgggagttcagaggtagggggtaaatgaggggagtaggtgggtagaaaaggttaaaagtaaataatgatgggaaggaagacaaaaagacgacaggggtgccaaaggactcttaacctcatctgaacggagttgccctgttttgctctctgatgctcatgtatctatccttagagacagcttggcgggcaatgtagagcgtaggggctgacatagggggttggagtcccacctccgtgacttctagcaaattagcaaactttgctgctgctaagcctataaggcggacagaaatgccatctttaaagcttgttatgtaaagtgcctaggacctcgtaggcatcaacaggaataatggatgaaacaaaacaacggtgcgtatcttggagaaagtggcatctgagcaggagtattttgaaaggtaggaaagggctccaagcacatctaagagattagggaacgcagaagccttagccctgggtgcagatttaaccaatcaacttctaaccaccgcaggctgagaggtgtggagtgagagccccgccagaggcaggagacccgggcttcggccagaccccgcctcctggtacagaggaccacgcccggctctgcctggagccaaatgtggatcaaaacagcgcgcagcttcccactgctggtgaaaacccgagcaaggggcctcagtttctttatccggaacgtggtgacaatgacatctctttgcaaggctgctgcagggctttctggaaatacgcccgtgaggtatctgggcctgcgcacagcctcccccgcccaggacccagacgtctacctgggggtcccgtctgcgctcccgggatggaaaacgcccaggggaaacttaggcaggcgagcggacgggcacctcccgcgggacgaactcactcggtggcctcctacttccccggccgtgttccaacgcctgagaataacgggaacagcggtcgtactcaccgacagcggcagcagcggtaggcccgggccccaccatgactcttcagtgacagtttttcttcaaacgccgcgcctgtagccaggaccggcgtgccgcgcgtccacgcgtcctcattggctcctgcgggtttgaaactcgctagtcgtcagcacgggagggcgggacaacaggcaataggctctttgcggttggctctggccttgagaacccgaccttggggccctttgattggaagaacgtgcagcgcacctcggcattgagggcggcttcctcggggcgcggcgccgcccgcctctgagtgcgcctgtgagtgcgcctccgagtgggcgtgggaccctccgtgggggcctcagccgggctggtggttggggggcggttacgctgaatccagctggggttggcgcgccgggagtccctgggcggagagacagggcggtcctcccaggatgctggggccgctacctgattctgtcctttcaaagtctcagactcacaggagctgtgaaaaaataatattataaagaggacatatgggtcttatgcatctaaaggctcctagttcttagtactgcagggtggctcgtttaattgtggtaaaatatgcataacatcacatataccattttaaccattttaaagtgttaaatttttcaaaaatgtgcagtttagtggtattaagtaccctcacattgtggcacagccaccactactgtcctttccagaactttttcatcttcccaaatgaaaccctgtacccgtcactaactccgcactcctccctcccccagccccaggcaatcaccattctagtttctgtctctatggatttgacaactgtaggtgccatataagtagaatcatgcagtatttgttctgtgactggcttgtttcacttagcataaagtattcaaggttcatccatgtgtagcatgtgtcagaatttcctttccttttaagggggaatagcatttcgttgtgtggagatgccacattttgcttcttggtccatccctctccggacacttgagttgcttccactttttggctattgtgaataataatatgaacatgaatgcacaaataactctttgagactctccttttcattcttttgggtatataccacgaagtggtattgttggatcaaacggcaattctatttttaattttttgagaaactgccttactcctctcacggtgatctcttgttcaaggtatattttcgatttcacctgatcagctgactataaggccataaggctaacggagaaacgcaggcctagtttctcctagttactaggagatcgcaggcctcgttgtcctgaatccctagacacacttcattccccttgttttaatcctaaattttttttcttttgaagtttgtcctgtttcatctattctccagtttcttaaagaggtctggaaaatgcttttggctccttgtgtatgaaggttcctcttccatggatgctggagaagtcgtgtgtggaggggcagtcatatctgggcacctgttggccaggttcagcttaccagttgggtactcagcagggcatgaagccactgcagcagcccttctctttagccgtaaatagggagtttggaagagagccagggtttctggatttatgcattttgatattttcaatagtgtattaaatgtttaaaataggaaaactgatcattatttttgttaatgactgagaaagggactccttcaccaacagtttcagaaaagtgaaggcggttttgttttggtctttgtagaatctaggtggttgaatgcatgtcagttgtagaagtcaccttgcctgatatcccacgcagtgctggagtattccacagaccccatgtaggtactgcacctttgcaggtatactgctggtgttggtgagctgccttacctgtcctgttattggagacccctgcttattaggaaacttaaaatgaactcaaatgagcttccttgcttactggtcctagtcctttggagcaacataggccagttctgcctcgtttttttccatcctttgggtatttgacggtctattttgtaggacacaaaatgtgggaaaatagctaggcaggtttaaaaattctcaactctaccaagcatggtggcttatgtctgtaatcaatcccagcactttgtgaagctgaggcaagaggattgcttgagcctaggagtttgagaccagactgggcaacatagcaagacctcgtttcttaaaaaaaaaaaaaaaattacaaaaattaaccaggcatggtggcacacacctgtagtcccttctactcaggaggctgaggtgggaggatcacttgagcccaaaagttgaaggatgcagtgcactgtggtcatgccaccgcactccagcatgggaggcagagcaagaccctgtctccaaataaatacataaattaaattcttaactcattcatcaaagtatccactgtagctttccatcatcctggtgttgttttttttagaaggatctggctccattgcccggctagagtgcagtggcatgatctcagctcactgcagcccccacctctctggcttaagcgatcacccacttcagtcacccatctgggtaatttttgtattttttgtagagatggggttttgccatgttgccccaggttggtcttgaactcctggctcaagcgatccatctgcctccatctcctaaagtgttgggattacaggtgtgagccaccacaccaggacaatcctggtggcttttaacggttttccattgctctcaggctaatgacctataagcccctgcgggcttggccttttactccctcagcattagccacctcccttagccttagcccacactactctccccttgctcagtgttatccagacactttgttttttcctttccatactcctctctgtctgggaatccaacctttctttctcatttctctagttgattattattatttttactctagcagccttattgagatatttacataccgtacgattctcccacttacagtgtacaattcaattttctaacattttcatcaccccctaaagaaaccctatactcattagcagtcactccccattctcccctcctctcagcccctagaaaccatgaatctactatccatctctatagatttgccttctggacatttcatatgtatgaaattatgcaatttgtggtctctgatgggcttcttttgttaccaaaatatcatgggtttgatctaggtcctgctgctcgctgcacagaaagccagccactgagatgacaagtattgccaaggaagaaggctttagtcaggtgctgcagctgaggagatgggggctcaatctcaaatccatctcgctgacctaaaaccaggggtttggatagcagggaagaaatgtaacaatgcgtaagaaaacaggaaccagggaggggcaaggaagcaatcctgatgaatgagtggtccaaagtctcattgcctggatgtggtgatctggcgagtttcagttctttgatactttttttgagaggcctgaagtcttttccccaggaaggaactcaaacaaaacaaatacaagcttccagctttaagaccagaagcgtcaatttctatgtttatccgaaagaacagtctatgggactattggttaagtttcactttcacttagtatgctgttttcaaggtttatccacatagcatgtgtcagtacttcattcttttatgactgggtattctattgtgcggatatacaatattttatttgccattcatcagttgatggacatctaggttctttccactttttggctattatgaataatgctgttatgaactttcatgtataagtttttgtgtagacatatgttttcaacactcatgggtatatacctaatgagaggaattactgtgtcatacgataattctatctttaaccatttgaggaactgccagactgttttccaaagcagctgcagcattttacattcctaccagcagtgtatgaaagttccagtttctttacatcctcaacaacacttgttattgtccatcttttaaattacaaccatcctagtggttgtgaaatggtatcacattgtggtttttatttgtatttccttgatgactaatgatgttaagcatctttttatgtgtttactggccatttgtatatctctattcagagtctttgccaatttttaaattgggtcagttgtcttcttcctttttttttgagatggagcctcactctgtttcccagctggaatacagtggtgtgatctcagctcactgcaacttccacctcctgtgttcaagtgattctggtgcctcagcctcccaagtagctgggattacacgcacctgccaccattcccagctaatttttttctttgtattttgagtagagacggggtttcaccatgttggccaggctagtctctttgttgactcttaaccatccttcagtctcagacaaaacatccctttctcaaggattgtgattagcttgattatttgcttatctttctccctgctagtctgtaaactgagggtaggccactatattcattgttcttggcaccaaatagaaactaaattaatgtcttttgaatgaatagggctttctccttttaaagatcccttcaatacagtaaccacactatatataagtagccacaagcccattcaataatactactagtncttgcgccaaaccggctcagcgttactatactggtctcaaactcctgggctcaagcgatctgcccccctcggcttcccaaagtgttgggattataggcgtgagccacggtgcctggcctcaaataactatttaagtgaaacaaaactagtatggcactaatgaaaaatgtataaatccataatcgcagagggatttcaacttacttctttcgattatgtaaaggtcaaacagacaaaagacaatgacaaaacttaatgcaatgaacacttttgatttaatgaacatatattggatatgtacccaagaattagagaatacatactagttttgagtttatgcagaacatttacaaaaatttagtggaagcctaaattataaaaagttgctgtcacgtagaataacacacaaacccctgagtccggaattcaaagccctccacactctcctctacctttgcatctttatcctccaccacactgcagtgcatactctgggctactactcactgttcttgattcaaattccatgttctgtcagctcaaatcattctctctgcctggaataactacttcatacatattctgctattgaattcttgtcttagcaccccatctactccaagacgatgtccagttggggttactccctgtcccattttctttgattacactttttttttctacttccattatattattgatcacatctgtgccacagtttttgactttgtgtctgcttttactcttttctagaccctgatagctcctgaagggttgggtcatttcttttttatttgctcattcctcatggcacagtgagtgcttaataaatggctattgactgaaattaaactgtatctaaatggacatattccacttctgggccattcattctttctttctattggaaccaggagatggggaaccataacaaaggtaaggttgtgccatgtgaaagaacatggaaccttcccctgagggccaaaaaagagcagggaaaggtgcaaagacaaaatcttccatttttaaacaatgtaagaatgtggtccacctcatgctcaggtgggactttatcatgacgttatttttggggacttatagctgcatcatttaccccatatacatttacctttagtgtagggaactgaggacaggaattttgttgatgcagactcttgctaatgaggctaacacttggagaatttttatcatgcattcaagaagcttgttttacatttcttcattaatactttagttggtggtttagctttagttgtaggcttatcagatatttggagatatcttcataaacgatggctttggttttagaagagttattctgaagctactatttctggcaataatcaaacagcatggccatttgttttgtaaggcctttcctagaatatgacggtaaaatctacgtgtggaaaaatgcttattcttctgtcctctataaatgtgaatctagtttgtcttcaaaatgaaatcaagtgattaaaatgtagttttctaagaagataaatggagcaaagcactctgtgtttcacagtgttggaaatcactcatccctcataaaactgtcccaactgatcctgactcacatgaatgaattaaaataagagttaataacatcaatttacatttttaaagacactttcccatgttttagactattggttggaaaagctggtaggtgtacaatttgtggagagttggctgtttttgtctgtcgttgtttgacgtatttcaaagccatatctaattttgttgcagaatggtctgaattctacaaaaatgttgagttgtgtagtgtggagaagtacggagccatttactgaaaggctggggggaaatgacgagaccctgagataaggcagtagtggtgcgaacagagtggaagggaggtagttgagatatgttcagagtagaatcagaatggacatagtgaacaactggatgcaggtgggggctgaggaagcaaagttgaggataattctgagacttctaggttgatccactgaagttacattattcaacaccacaaggaaactaggggaatgagaaggcatactggtttgctttggagtggaagggcagtgatgtaagaggagttaatgagttaaagtttggatatgcctgaacttcaatttgatatgtgcatctgatatacccttggggtgaccctccaggcaatggttgaacatgtgtatttcttagtaactgataggcatcacagactcacatcagtaaggaagcaacagcaaacttgattggacgatatacctggaactcagtaccctatgactggagcaagtctctgtcagtgaaatgaggataagaagaatcttgaccttgtggaatatgttgttaggaatatatgtgatgaacaacataggatacttcctacagggctccacatgtagtaagggctttataaatgcttgataaatattattgttgtaatttatttccaaagtaagatgccactggaggaatctttggaacccaaattaataacaaataggactggatgcaatggctcacacctgtaatcccagcactttggaaggccaaggcaggaggatctcttgagcccagaaattcaagaccagcctgggtgacacagggagaccttgtatctatgaagaattaaaaaaaattaaccagatgtggtggtgcacgcctatagtccctgctgcttgagaggctgaggtgggaggattgcttgagcccatgaggttgaggctgcagtgagccataattgtgccaccacactccagactgggtgacagagtgagaccctatctcaaataaataaataaataaataaataaataagtacaaaccagcaaacactaatcctttctagagattattgaactctggagggcagatctgaatggagccagcagagggacctatggagatcagcctggccctggacagcaccaggcaatggggttgctagagaggtaatggggttgaacagggtttaagccatgaggtctcaagaatccgtgaagactcagactaatttttttttttttgcatgaggattaggtgttcctaggaatttcaatgagagcagggttaatgaaggaatgcagggtaggagagctgagggaaggcatctgagagagcctggcttatgaatggctgcgtcagtatggctcacctgctttccttgtatctacttagcagatgatcccaccccaggcctccagggccaaggtcatttccacatagtcatgggcccttgagggcctggagcagtgtaaggaagacagagtcttaagaaattgcattaacagtcatggtgcttggcaagtgtcgtcatcctatgccaagcctgatctgaaggggtgcatgctcataggtagctgctgcccaagattacagcagcttcttcaatcccagatccatgctctcctatattcatttttccaggggttcctgtccttcgacagtgatgagatgcagaatgacttattgagttattctcctgatagttgccaacttttccaaatgacaatggggcatggagcttgagagtggaaatgaggccctagggatagcgtgcttaggaaaacactcccagcctgatgtaattctgggggtacaatggcattttcatcatcaagactgatgtaaagggtgactagcagtgagttgggggtgactcgcactggggctaggtttctgattctgcctaatccagacagagcagaagcactagtgggctggtagagggcctccagggcctcacttaatgtcctggaaaaacagctccagattgttggttcacgttctgaggacaagcttgggtactacaggatagagagagtggtgggagatgccgtggcctgccctgctgatgcctgccctgccattcctgcgtgtgatgtctctggggcatcttgccttccctgcccagacctgtagttcagctgagggcatgtggaggccaaatggcttcttagagtgttactttccttgaacagctctgctgggagaactggaggagctagctagtcacggtaactgcagcagtcaaaggatcgtcccggtggaggtggggtggaaaggtagagaaagagaacatatagcgttttccttggagatgtgtgggcatgtcatagaggaaatacccaattcctgagccttgagccctccaggaaaccttggaatattaggttagtcatccccaaggaagtctaagaattctggtctcacccatctcctttaattcccacaatgatcctacatgatattaaggaacacgggccagtaaccctccaagcaatggatgtggtggtgaagtttgacctcatgatggagcggaggttggtttgaaacctaagaatttaatttattgtttcaaactgttctccactcagcgttattaaagcatacataattgacacataaaaattgtatatgtctacggtgtacaatgtgatgtttcgatctatgtatacattgtgaaatgattacaacaagctaaataacatacccattcatcgtgtttcaaaggaattaaactcaagcacaaaagagaggtgctgttgaagagtagggctgctctatctaagtagtatgtctggggttgtcctggatcagggtccttttgtgctagtaataaaccagcccttctggggctgctccactttccccacattttcttctggagcctccctaagaattaggacatggccactttctctgcataggcttcctacttcaacaaggacagggcttgtgctgccccatgccacttgagtgtccctacagcacagagctgagtgcacactggctgagtgaggaaatcccccagattaatcttggttctaagcatcatggctgtatttcacacgtatatgaattacaaattacagcatagtcgaataaggatttttgtgctacaactggaatcccagattatgcaaattggatagtataatattgaaattcctaggactttttattagttttaaaaaattatacaagcttagagtaagaaattaaacagtgcaaaagaattcactgtgaaaagtaaaatgctctgtctctgctgagagacagatattgcagcccagatactactggggtcaatagtttcctttaagcatgccattttgatggtttatgggacttacagctcaagaagcttgacactagggttgatctcagaaaatcattgttgcaggtattagatatgaccgtctcataaagatacacacacagacacagcgattggagatattcactggggcttatgggctgcttgtcctttctgctctgtgcctaagttgggctcagagtagcctggcatcggctgtggggagaatgctggcatggggttagcaggagcccacttaacatgtcctaagccacctggaagagtccttcaaggagaccagactccagaggccctaaggaaggaaggacttttgcccgtttttaggtattctagtcccagagtttagggaggaatggtttggctttgggtcgtgtgcccctttaccgagtgggatgggatgtgcccatgagctgttgagctggctcttggagaagacagcaaaagcgggaataagaggtcaggaagctgtgtggttgtaggaaatcccagcagagggcctgggggtcaaaagtggtcatggtagtgacggtggaggctgaggtggtagaaaatcagaggacaaaccccatgggctgctggtgatctgaccgagctcctatgctctcctggttcattttaggctctgtagcagcagatgattggctggtgtgagagcagtgcacctgccatatcaggcaatccaagacaagtccaagctacgctgggaggaaacctgaaggcagcagcaggtagactggctgaagacagacaggcaggcaacttgtcaatcagatttgtgtttttaaggacttttaactggggagccctccgggacagatcagatgagagtgaaatgtgctccgccttagccggccgttcgcaattctgtaaaagggagagtggttttatttatttttaaacatagtcaagctgctaaagtatatgatatgtatagatagagtataattaaatactttcaactacagacaaaatcaggagaatggaattaaaaaacaatttacaaatgggtaatggcagcattgggttgcgcccacccacgagaaggcagacaccaagattctaagatcacacgtggccagcacttcagacttcaaatagaattcgtgattatgcattatttttctcggaaagttttcacttcactatatgctacttgacacttgctttcctaagacatccctctatttttgagatgactaactcagcaattcatttctctcacgcataagctgtcactcaacccaaacccaccaagcctgcattctaccctcaataaggtcttggtgtgtaaactgacccacttcacctagttccttagccctctcttgaccagacatgactctttcataagctagacctataaagtcagggctcttaagtagctgatctctgatagtgccaagtgtcccccactgttcacattttccactccagcttctaacaggtgatagactgctttttgggggtaggggcaccaaaacatatagacctcatgtttggatgtagacactccagtttctttaaattacaactacatattaataatgacttccaagtgtacatttcagtccagatctctccctggatccccaaactttgtaaaacccaccgcctagttgatatcttttgatgtctgacaggcatttcaaatttaatactgtcacaaacaaagttattgattttcatctctgcatctgttacaaatttttcttactttggtaaatagcaccccaggctgtgtcactgccaagaactttccacagctcttggaataaaattcaaaatattttccaaggcagaaaggcacagtgtaatctggctcctgcctacctctccaacctcgtatcacactagtctccctgtcactcaccccctccaggagctcaggtatccttaaagtttcttttctttttttttttttttttttttttgaaacagttttgctctgttgcccaggctggagtgaagtggcatgatctcaggtcactgcaacctccgcctcctgggttcaagtgattcttgtgcctcagcctcccaagtagctgcaattacaggcgcgtgccaccacacccggctaatttttgtatttttagtagagatggggtttcacaatgttggctaaaccggtctcaaactcctgacctcaagtgatctgaccacttcagcctcccaaggtgctgggattacaggcgtgaaccattgtaccctgcctccttgaagtttcttgatccagactcattcctgccttaaggtcttgcatcttcagtcctcccctcaaatgacacctccatgaagacgcaattacctgtaattaccgtgtcttatttagtcaatgtgttggttttctgtctcctccactacagtgtaagctctatgaaggcagaaaccttggcagtccagttcccagcacagtgcctagcacacataggtatttaataacacacagtaaaattcaccttttagtgtgcaattctgagttttgacaaatgcatcaagtcatttaagtctgactattatcaagctataagatggttgcaacactatcactaattccctcatgctccttggtagtcagtctcacccctaacgcccccctcctggcaatcactgatccgttttttgtctttatagttttggtttttccagaatgccaataactaagttttgaatgaatgaatgctattaactctcatttctgactccagagcaacatccatgcaatatttattatttcagccccaaatactgccccctcaccttcactccaaccacctacttgatgatacaaggtgagacatttggcatgtgcttcctccatgttcctagcattttccctatctccttagccttccttctaatcataaacgaagagtgaactttccctttctaaaggcaacttactcctaggacctcgatgccataattttgtttctctagtactttctatatatacaccaaacaattagctccagaaaggtaaagactcactgtgtgctcatcactgtgtctcctagcgcctggcacactgcaggtgctgaagaaacacctacagaatgagtgaatgaatctctccctctctagactccttctcttttgtaatcaaacatgttcaacctgcaacacagtcttatgaccaatcctctgttgtctgacctaggctgagctccagggctgggaccctgacttccttattcaccacctcaaggtctctgcactcacttctctttctgctcaggattgtttttcttcttgtcaccagtcttttctcagacttaggtctcagctcagacattgctgttgaaagtacttctactgatccttttatctaaagcagccattccagccctactctcttgatcatagcaccctgaattaagttgtttacttactgtctcttcaggagggcaaggagcttggtggtggtgttcagggctgtaccaagctgtaccttgcttcaccctgctacactttttagcaaccatctaattttacatgctcccttcactcgtcagaaatttccttattttctacttcaagcaggtatacatatgtgcttctcctgggaggctcacccacttcatgagactacatttggtcctgggtagaaagtgtacaaaatccactggctcagttttaatcaatgtatgttaatattaaccaacctgagatcttgatttccacgcctggctaattttgtatttttagtaaaaacagggtttctccatgttggtcaggctggtctcgaactcccgacctcaggtgatccgctcacctcggcctcccaaagtgctgggactacaggcatgagccagcgtgcccggcctaagatcttgatttctaccatctgaactctgtatttgaactgactgctcctgcttgagcttactggccaaaacttggcccactcagactcacggaagtttctggttcttccctggtaacttttctgaacttaaccactggtttgcttgacaagagattaccatcttctcacttcctagctatgtgaactcacttatctgctctattgctgttcagtctagcacggcacttattgaacgagtgtctacatctgcaccccctacttcttactcatccattctgtttcaatttcttaaaaagaaaaaaaaaaagctattgtaaacatacgattacagaaaatgatttataacatgtgtatgtaccacctagccctgtcaagtcttaatatttgttatatttgcttcaaatcttttttcagactgtagttaaaaattacttaggagccattatttatggcctatttcctgacctagtcttcttgatggtcaatttgcctaatcatcttaagttgcaaaagcttagaattaaagcaaagtaccttcgatcctctgctgttgccttctttttaatatttgggtttgtttgggtcccatttacggttgtgacatcagcttgagttttgggagctgtcttgttcagaaaatggttctggggaacagcctttttcaacttggagtccaaagtctgtgctttttgctgaaagccattattgttatgtttattaccactggttccatttggtcttatgctaggggtgcttggaatggctgaattaaatctgccaactgtcaaattaggcctctggcttacggcttttgacttttgcagtacacatgatgtctgaggtatacaaacttggctggacttctgatcttgcttgatgtttggatgtctgttgttatattcaccctgaagcaaactggggtatgttctgggtttggtgtgcttcactctctgttcagtaacagggtatgaccgtatcttagtttcatttggtctttcatattgactcctattaacctttatatctttgatgttcttgactactggtttctttgatgactgaactttactaagggtccgaataaagtgagagggaaccgtccttgagggttttactcctggtcttgcaagatctgctcctctagagagttgctgtgattttactgggaaagtcctgctttgtgtttctccaacaaattgtttattaaccctatctttcagaacagcactattaactgaacttttgcccaaggcttgtttaggaactaaactgttcttggtttgattataagagtcagtctttggcttacttctggtatataatttaggatctggcttcctctcaggttctgttaagatatctagcaagttctctttgtttgtttcttttagaaagttatccaaagattcgttttcaacatggatattattcataaagtctatacatttaccatttccttgatctgttaactgctgctttgtagttttcaattgctctatattaagtgaccccacaggttttcttgacagtcctcctgtggtggactatctagcttcacactgttgaaaactcttgctgaaaagcttagactatgggttagaagaaacacattttgaagtccgccttttgcccagaagttttggtggctctaacttcagcttctgggaccctgcagtattaggtggtctgggctggagtttaatgctgatggaccttttaggtttgacaggcaaaacaacatggttggtaacatcatttttgggtctaatagtctgaaaaaacaaagaaaatacatattaaaaaatccttaacatatcttattgtttttaaaataataactgtgtttaacacatgctaaaaaaaaaatcatttttagaatttcatctaagaaagttgaatcctcagaaagtaaagaaagactcactaataggtagtttttgtgtttttttttttttttttttttgagacaggatcttgctctgtcacccagtctggtgtgcagtgatgcaatcttggctcattgcaacctctgcctcctgggttgaagcaattctcccaccccaacctcgcaagtggctggactacaggcgcatgtcactacacctggctacttttttgtatttttagtaaagttggggtttcaccatattggccaggttggtcttgaaatcctgacctccagtgatccacgcaccttggcctcccaaagtgctgggataacaggtatgagccaccacacctgtcctaacaggtagtttttacaacttgagttcctatcagaagtatattagaatcttttagcttgacagaattaagcagagatgcagtgaatatacaaaacttgctctttcaaaaatgaatttgcctcaaacagtagttgttgaatgcctattatatcctaagtgccctccaaagaaccctgaaaaaatacatacataatgaacttatgttagggtacctcccaacaaatctctcctagtactttgtatagccacactatatgttttttaaaccactgcctttgtaaacatcacagtatcactcaagaacctctgtctcatccctggagatcagtgacaaggagataggtggcagatgatgtgaggcctgagatatgctgccacagctctcaataaacatgtaacatcttaatagtcatatttgtaaaatcagccaggacagggttttaaggttagagtctatgttaataataaacaaatgtttagtcatgtgatttaagtttggataagaaaggtaggactcgattacagagaattttgaaaactagggaagggagtttagaattcatatggtaagtaattgggcaagccactatgaattcctgagcatctctcatgaaagcaattactcagaaaggagaatttcacagagatttatggaatatgtttccagggtaagatatgggaatgctagagttaccactctatttttgatttgacaaatattgtgaagaatcactacataaacttggcgagtatgtaaaggatttctaaccagaaccatttggcattgagggcaaagaaatgtctactctggatgatagcggtgtgtgtggtgttactaggagtgaaacagcggagttgggagtgggaggcagagagatggatggtatacccacaatggctatatctggattaatctttgagcaccaacatttatatacacctcggatctctccatcattgcttactgaagaggtggagggacgttggcatgaaagcttccaaatgtgtttttttagttgctttcttatatattaaaaacgaattgatataatccacaaaccataaaattcaccattttagtaagtgcacacttctgtggattttagtatagccacactattatacagcaatcaccactgtctaattccagaacatattcatcacccctagaaagagacttgggtttacttgttggcagtccctccccaggtctacatgtgctcgcaagattggatattgaaatatcagcaagaaattaaatgacatagtagtcattatgcctaaattattgttattttttgattgaaaaaagttgaatatttcaaatatcaaggtagtagtgagatataataaagagagagtcagttctaagtatagaattgctgattcagttaagctctgttctccaacatttgggccacattgaagagaccatgtagctgctttcagcctcggtttcctcctttgcaaaatggggattacactacctgcctcacagagatgtaaacttatgacatgttatcatgattgccagggcccacctgttttcttttaaacattgaaatcactgtgcctgaaacagggatttccctgccctttgtgcaagctccagaaacaggagtcagcctgagtcccgcagctaagaacgtggattctggtcattttctcatagcgaacacacttcacaggtccttcaagggagtacattttcctataactcaccttaatctcagttgaagcctcgtttcttattttgcactgtggccaaaaactaaatctcatttctttcacgtaaacttcagcaattcaataatagtacagtcattttatgtttcaactgaaccaagtcagggttccactcctgcctcccctttctgctctgaggacatccatgaagtggagggggtctatgtagcctggagctattggtgaggggcgatgggtccgtggtggtcttggggaactgcggggctgtgtctggctggtctggtgtctggtgattggccttgttccacgcggttcacgctgcaggacagttcgtgtccttcttgtcctaatgatcagcttttaggctcacgggcctgtctctgctgagatatggaataggacagcctctggatcttctttaaactctcctggggccacaggggactctgtttgtgtctgtgcccacataggatgattctgcccagacctttgctgccatttcttgctgttctgctgtttttagtctctggagggcttgcagtttccttggggtccctgtggaagcaaagcaaagtcctctccacgctcagatgtctaaacgtatctgggttttatcgtccacccatcccagagctcagtctagaggagggggcagccttcgggttctctccttcctcccagagcctcttcctttgcaccagggcagcctcttcctatctgttggaaagggctgtctggttcttgaatatagagttgcaggtttgaggggtgtaggctgaggtaaggcaaactatcacatggaataaaaattaccctgtgtcaaggaacaaccagagctggacagtttttaaatgtgaaaaccaattttattcaggactatggcgagaggtgaagtaagacctcagtatagaactgggctcaattccgaatgcagcatgggcaaatgggaatgtatagcctaggagcagggtgggaacctgtggatgaagaattactaaaagggcatatcaggggtgagggggcgtcctggctacacccactaactactgttgctgaagaaaggcctggtgacatcactggggaatggtgggggatgaagaatccaatcagatggatattgaggataaggggatcttgataaactggcttaggagggtttttgctaaaactggttttcataggtaagtccacagacaggtcttggagaaagttcagggacctacggtttgttcgggcagatgctttgtcatctgtcacactggcactgtcacctggctttcctttagtccctcccccccttttttttttctggagtagttttgggagaccagaggagcagggagttagggagagtagtcagaaaaggccagagaaaataaggaggtgtctgtagggaaaatccttaaatcctctaattaaattaatttaatttatttatctgggacaaggtctcactctgttgcccaggctgaagtgcagtggtgtgatctcggctcactgcagcctcgacctcagggctcaagcagttttgccacctcagcctcctgagtagctggggctcacaggtgtgcactaccatgcccgggtaatttttgggttttttttttttttttttttttttttttttttgtagagatgaggtttcgccatgttgcccaggcttggtctcgaactcctaagtgatccatccacgtcgacctcccaaagtgctgagattacaggcatgagccactgtgcccggcctaaattctccaatttttaaatgcttccctgttccctgttccagatttgggatattgactgctgttaaatcagcgatttctccctgtggagaggtagccaataggaagcaacaagagtgaggagtccttatatcgaaatagagggtaagagaagagacagatgttatcttggcagtgatttaagaacagcgagtctgtaagcaaagcaaagcaaggctcccaggtgctgagaaacaatggctttctggggaagcgtctgtgttcagaaccttaagttggaaacatctctgaagatgtttgccatgaaggttttcttctgaagttgagtctttcatcactaggtaggcgtgttttggagtctctatcaaacagatcctgtgtttattaggaagctgtggttcataaagccccatgctaattttgcaggtagcagggtggccctggcctgacccggggacagagtggctgtcctccctccaggcaggaaactctctcctgccacctagtggctgcatacccacatttcaagggagcttctgggtggtgagtttaccagactatggtctgaggtagagttaagcaaaacaaaactaaactgcataaagaaacagaaagaaaatcaggtgttataaaaacaatttggcatttgtttgtgtttcagctccgtgtcgatttattgcttccacaaatagtgccgatatgcaccaggcactgttgtaaaactgaaaatatgtttttggatgtgcccagtctgtgagtattaaacgatggttgatttgaaatttgctatgattcatatttctgggggtaagatgcaggatttctttggggggcctacgatgtggcattctagaattctcaaagaatcaaccctggtgggaccaggaagagctgagctgaggcctctctgctcatgtgtacttactggagatcatggagacaggtgagcctgagtgcacgtctcaccaaagccacagcagagggggaggaggcggaaagagagctctctccatttctgagaagttaatggtaacaatggcatacatacctactttacagttgaaattggaaaccacagcattaagtgtttccaatgaaatttggcaatttgggagttttctgagctgcattggatgtggttttgcatgctgttaggatgagcaagagatgatggagaacatcttccttttgagcttcctcttggacgtgggtcactcccactcatggaattagaaagcttagacctagacttgaatctcaccttctcaaggtgctcccgggcaaatcacttaagatccatcttcttctcctcctgctccttctcctccttctgagtttttttttttctttccaaaattcaaatgacacggtactggtagaagaaaaggtccaagtctgcttttacagctcccctcatccccaaatgtactccgaccccaagatgaccatgttatcatttgattgacatccttctagtttcaactcatttctttgcatgtatatgcacgtacatatacactattttattttgccaggggtcaccgtttagctgcattaatttcttataaaataatctatatttacttatggtttacgtaaaacaacatacacatgtaagtgtatagcttgataagtcttcactgtaaaccaaaaataaaattcgaagcccccccaaccgtctgaatggacccctcttcttggccaagagcattccaaagttaacctgaaaaaactagttcaggtcatgatggaagggaaggttggacatgccccagtatacccttctcccttttggaattcaggaaaagctgaccagcattaacatcaacacagaccttatgtctgataggaaactttgacaatctattccctctgaagcttgctacccggaggcttcatctacaagataaaaccttggtctccacaaccgcttatcataacccagacattcctttctgttgagaataatttaccttgtaacctggaagctccctgcttcaagttccctcacctttccagattgaaccaatgtaaaccttacatgcattgattgatgtattatgtctccctaagatgaataaaagcaagctgtatgttgactgccttcagcacaggttgtcaggacctcctgaggctgggtcacggatgcatccttaaccttggcaaaataaactgtctagattgactgagacctatctcagatactgttgggttcaaatatataacttatgaaactaatacacaaatcaagtcatagaatatttccatcactcctcatctacccccaaatttccttatgcgtctttgcagtcaacctcccaccccatccccaggcaactgcagatctactttttgtctctgcaccttcaactgaccctttctgtgatttcatatgaatggaatcatgcgctgagcagtcttttgtgtctggcttcttttgctcagcataatgtttttgaggtttgtccatgtttttgtgtttgtcaatggttaatttctctccattgcagagtagttttctattgtacatgtgtaccacaatttgtatatccattccattgctgatggacatttgatttgtttccagattttggcaattatgaatagagctaccatgaacacccaggtacaagtctttgtgtggacttatgttttcatttctcttggaatggaactgtcatatcaataagtatatgtttaactttgtaagaaactgacaacaaattatctgcgatggttatgccattttgtttttctaccagcaatacacgagcatttcagttgctccacaactttgccaaaacttgttttctttaatttggacatttaagtggtgtacagaggcatctcattgtggttctagttttctttgccctgatgaccaatggtgttgaacatcttttcatgtgctttttgaccatttacatatcctcttttgtgaagtgtctgttcaaatatttttgcccatttaaaacatttgggggtttgtcttattattgtgttgggagagttccatatttatttatttattgagatggagtctcactctgttgcccaggctagagtgcagtggcgtgatcttggctcactgcaacctccacttcctgggttcaagcaattctcctgccttagcctcctgagtagctgggattacaggcatgtgccaccacactggctaagtttttgtatttttagtagagatggggtttcatcatgttggccagactggtcgcaaattcctgacctcaagcaatccacctgcctcggccctacaaagtgctgggattacaagcatgagccactgtgcctggcccatatttattttttattctttattttgtatacaagttcttggtcagatacaataatacctggtcagatgagataatgagttggaaaatgctttgcaaatgggggagaataatttaaatgttatttatttattaagagcagaggcccttcctgttgcggtcacagaagccgtttgcttcttctgccttttataaaccagcagagtcgagctacacaggctgtctgtgttggctgctattagttaatcagagagttttttttttcttgccttgtcattctaatttgtgacacataattagccacaatatgtgttttcagttgtgacactggcctgggaaaccaagggatgtttagagtggatttccttgattttgcaataattgtgtgtttttctgcatcttctgttaaacacaaattcatggaagcaaaacatggaagcaaagtaccctggacatccccccttctttatgaaattgatttctcttaaatgtaatgtttgcttgttcccttactttaaaagcaatttaagagtttattgagaaagtgagccctggaaacatagatgcatagagagaaaattctaccaccctcaggtccctattgtcttctctcataaagtgtagtttcagggccttttagaagtttcttttctgctctgatttgcatgtttgtgagtgttgctattttaagtatttggatttggtctgcaaatcctatgagagatggcaacagagtagggatctcaaagcctgcaggttgtattaagtccagcagggccttgtatttacaacagagggtccttgaagacattccatatattatgctaggggagtggccaagcaaactttaatgtgtccctatggtgggatatttggggttaatacctgcccttctcttaatttctttttcttttctttttttctttttctttctttttttttttgaaatgtagtcttgctttgtcacccangctggattggagtgcagtggtatgatctcagctcactgcaacctccacctcctgggttcaagcaattctcctgcctcagcctcccaagtagctgggactataggcacacaccaccatgcctggctagtttttttttttttttttgaaacngaatctcgctctgtcgcccaggcgggactgcggactgcagtggcgcaatctcggcgctcgcatccctcatatccatgagtgttctgtgggccctgcctctgaaataaatcctgcctttgtctcccagttcactccagccacccatcctggggctgcaccctcctccttccaagccctctccctttccttcctggtgctgcctgtcatgtcaagcatatgcatcagtgcgaccaggacatttgaaatgcaaccagtacaattgggcgcggttatgcctaccagtttttcttccttaaacattttatatttatgtttgaaagcatgccacctttcttcacttgccaacttgacagatttattagttgacaacatccgctgatagcatcagtaataagttaattgtttttgcacatgtagctttaattattctcattatcatttataggagttattctttgtaaagggtaactgagttttccaaaacaaacagaaatttggggtgggcccatggagcgtgactcatgaaatcagattcttagaaggacctcggcaagtctctgggttgctgttaatgagcctggctggctgccaggggtgtgtctgccctttatgaggccaccactgttcaaatgcttgcctgcagcattacttgcctaggtagtgcttgtttctactgaactgtcagggatccaattctttgtggtctaagtaacaatactcagattcacaaggaattgattaataagccagaatgccaatgtattacatttttgatgaagaccatatttacagtgattgtatctgctcaagctcaaattaggattagagttctgacaaatacatatgtgagaagtatgaggttaaatacttgaaatttggacttttctagaaaatctgaatgtgattgccattcacatacctttctggggatgatgattcttgtacttttattttaaaagacatagaaaactaacttaagaatcagattgcttggctgggcacagtggctcatgcctgtaatgccagcactttgggaggccaaggtgagtggattgcttgagctcaggagtttgagatcagcctgggcaacatggtgaaatcccatctctaccaaaaatacaaaaaaaaaaaaaaaaacaaccaaaaagaataaattagctaggtgtgatggtgcgtgcttgtagttccagctacttgggaggatgaggtggaagaattgcttgagcccaggaggtggaggtttcagtgagctggggttgcaacagtgtactccagcctgggcgatagagtgagactccgtctcaaaaaaaaaaaaatcagattgctttattgctggttttctttctaaaactgagattgggtcccatcatcccctggcccccattggttaatggttcctcctttgtctattgaataaaatacagatgtctgcttttggcaacatggttgaatgtagacactgcagggtcttcctgactcaaaatgagtaaggcttagataaaacacattttgaaatgcatttctggatgaacagcaaggaaaggagatctcttaaaatcctctttctgttcccctctccctaccccctccaagtgggcttaagtaggaagggtggtgagcggcaggtaaacacacgtcaaaggcagtcttcctctctgagggaaaacacttgtataagcattgcaatcaatgggcctctttaattatgtgccagtggcaagagcgggtgctgaacccaggggcctgcctcaatccggggcctttgaggcagaataaagtggtctcaggttgttggcatttccttgcccttccacccgaagcagacacaaatcctctctggaggcaagttccccaattcagccagtacaactcccacagactaagatcaatcatgtacaagctcacagacaaaggtcaccaaacacacagagcaataaacaaattcatgagtgacgtgaatgagaataaacagaaacaataaccaccagctgggatgctctaagtcttcagctgttagaattcctgaatatagaataaaactgccacaatggcaaacatgcatctagtacttactgtgtgctgggttctaagaattttgcacattgtgccagataccgactcagcttcacactcaccctcctactgtgccctcttaatttgcactagattaaaaggtagaaaggaagaggcagctattctgttcttggctgtgcctctggcagcacatgcaaaatgggcagtaacagtggcagtcacaggtaagtagccttctcacagtgtggagttaaaggcatgggactgagacgagcaaggttcctaaagggacagtggccagtagatgaccaggggctactggagtggctgcatggctctgtggaagctcagaggagccttgggtcctgcaggtgcagtagcagctttctgtagttcctgatctctgggtcccacaatcttccccgtttttgctcctccacttctaattttgtaactgacttccctgtgtgtacttctctctctgattgaaatagccagactggtttctgtttcctgataagacattgtctggtacgaacacagtaactcatttaatccgatatctctatgaaggaggtacaataattattcctattttacagatgaggaaacacagcagagaaataaagtcaattgtctaaggttgcacatttagtcaagggaagggttgatataacatataattatttagaaaacatctaaggaaataaaaggcataatttaaaaataaaactaggcaggtttaaaaaaatgaagtaatctataagtaaaaaagtataattgttgaaatacatatcttagtggatgggttaaatagctgaagaaatgattaatgaactggaaggtagttctgaggaaatcagaattcagcatagatagaaaaaatgggaatttacaaaagtacacaggaattataaaagaggttaaattatagggagggtagaatgagaattaacattggtctaactggaattttggaagaagagaatagagagaatgaacaaggcaatatttaaagaggtggctgagaatttttcagaaccaacacaaactatgactttaccagtagagaaaacaatgtacactgaggaggataaataaatatactatgaacaaattgtaataataatactcaacaaagacaaagagaagatgttaaaatcagcaaaaaaagaaagtcagacttagaaagaaatgacaatggcagactactcaacaacaacaatggaatccaaattcggtcaaacagtattttcttcatgctagcatatagcgggagtccgctatgctcctaaagatttgcacctctgatctggtttgtagttagtctcttttattgctttatcctactcaactaatttttttagtgcctgttttttttttttttaatgtgtgttgatgactacaattctaaactcattctactgattcatgggtgctttaaaatctgagcagtctttcgcatttactgcctgtgatggcccatcccaccagctaaagtgtgtggccactgcttacagcaccatgtgataacgagtaagggagagatgccgcccagactcttctaggagcagccagtaggaccttccaggggttgcaagcaaaccacagcaatatgtggagtgtggcagaggatggccccaagaggatgtggcagcggctagtgcagctcagcttagtctgagaggaaatgctggagaggagagcccagtctgtacaggcatgacagccacaaggacttcaacagctaacatggctgagtggactttatgtgctatctcattcagaaaacaggagcaatcagaaaggagtcacctcctatttgtaccccaggaattgctaacctacttgcatctgaatgatgtccatcacttcccttcatcacctcctctgggggctctgcaaggatttgactcctgcattagtgatctgtctcacctacgttgtgattcacatgaacttactaatgtgctatgtgacaactaccatcttaaacacaaaaaccctcttttgattctgtggctccctccagctacccctgcatttctctgtccccctgccccgtctctgcactcacttttattttacagcaaaactactcaagggagtctcagtgctccttggctccatgtctccacctttcattctctcctcagttcactcctgtcaggcttccgtcctcaagctcttcttcacttttgttctagggccgctgacatcctctttcttgccaaattcagtggccaggtcctcacttactcaactgctcagcattgttgggcctggtggaccacattctccttcacccaccttttgctgctctctcttctctccagatgtttctctcttctcactggctactcctcttttgtctcctttgttagctccatttcttccttccaacctcactgtgctggtgtgcccagtgctcagtttttagctattctctcttttccagtggcattcattagatggtatcatgtgacccatggcattatatgccttctacatgacagttactcctgaatatgaatctcaggaaagatttggatttatttttaattaatttttttaaattttattttaataaatgaggtctctctctgtcatccaggctggagtgtagtattgagtgatgtgattatagctcactgcagccttgaaccatgggctcaagtgatcctcctgcctcagcttcctgagtagctgggactacaggcatgtgccaccatgcctggatgactttttgtgtgtgtgtgtgtgtgtggagacagggtcttgctctattgcccaggctgatcacaaactcctggcctcaagtgatcctctcacctcagcctcccaaagtgctgggattacaggtgtgagaccatcctgggctaagattcagattttgtattcaattgactgtttgacatcttcacttggacacctaagaggtatctcaaatattaattaacttggccaaaatacagaacttttgacccctgcccccacaatacttgccccttccccagacttctccatttctgttaaatatccccagttactcaaccctcaaacctatgaatgccctttgatttctttctttccctcatctcctacgttgacgccatcagctagttttgttgcctttatgcccagaatataatcctcaccaccttctctcctattgcccgagtataagatgtcagtttttcctgcacagtccattgccctgacctcctgagtggtttgcttccacttttgacatttgtattcctctttcccccagggtcaatttttcacagcaagagtggcattttttttttttttttttttttgagacggagtctcgctctgtcgcccaggccggactgcggactgcagtggcgcaatctcggctcactgcaagctccgcctcccgggttcacgccattctcctgcctcagcctcccgagtagctgggaatacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccaagagtggcatttttaaaaccatatattagatcattgcttttgtgtttgggaacctccaagggctttgcatcatatatcaagttgacacctctcctacccaagcctggctctttcctgctcctctgtcctctcagcccctccacccattgttcatgctgcttcagccacactggccttcttgccatgccacatttgtgctaagcccacatccaatctcggggcctttgcactcgcatttcctctgcttggcatgctgtaccccagatctttcatgattggcagcttctgtacattcagccacctgctcaagccaccctttcagagggccttccctggccacctcacctgaaatagcacctccgattgcacccatccggttattctccatcctgttctcttgcttggtgattttccatcactgatgaggaaatgaaccatggaatgctagggctgatgaccagaactttcccccacccccacattattacagaggaggaaatgaggtcggaggtaagatgggcccaggatttctactcccgcctggactgcaggcacagcactgacctcagctgtgctcactcttggcattcacccaacccttctatctccaactgccccatttaccagaaagtgaaatgttctcagagacggtgagccacctgacttggacagcagcccagggcccctggcaccctgctttcttcctccctgccatcctttcctctccaagacctacctttccctgtgattcttgcccacatgctgcatttcatggttttatgacctgatttctgagagggatttgaattttcatgattatttatgtaagcaaatcattatgcttatacaaatgagaaaaggagtgcttctggacttcccagggacaaaatcttgtcacttggcttgctttcatattgctaattaaggacccaggatgtgggtgagatgtgctaaaagctgagaggaggctctggactctgactatgggcccacacccctgggcaggcatcacactagtcctttaggtcatcctcaacccagcttccagttgaatcagatgtttgtgaataactcagcaaggctgtatgggaaatgaagaatgaggtggggaagaggcctgtgcagaagacacactgacttacccctctacctctaactagggtgttgtagcagccacccacccaccaagtctgtcttccagaccacgtatgctttcctccacctttgcatcttttatcttctgccagcccagatgcttgctgactccagcccaagcctataggataagctacagcctgtccctacagactacgcattgcagaatctaagacatcaagtcaagttcggaagcacttgccttctcctctccaggtacacaggctctcctggaaagctggtagcagctgtggaggtgtggtgtgttacctgctgcaggtgcagagaagttgacttcacagcccttcagaaagactgccttcttccagttgtatttgtgtacttgcttgggtgtggggaggattctcagctttctccactcaaattatcagaccctttccatttagtggtagaccatttccctcgtccaggccaagggcacatagtacagagaaatagggagttgttacccagggagagaacttggctctaaacctgtaatagaaaggtcagttctggtctggagggtcaattttgatctttggctcagatccaggaattggaaccaaggcttttgaacattttaatgcaggggattaaaaaaatgatacgagtcattcacgaatatatttgcttaacatctaaagagatccctcaaaacactagaaaaaataagaacaaaaatctaataaaacaaaatttgttaaacacatttaccaaatttttttttttggtaaaaattcaaatgtcataaataaagctaaagttcctcttgatgactcgctcctctgccctattccactccaagtaaccactattatcagtcttgccaatacccttccagacctctctacctctatataccattagaagcacatggttttgcattgaggatgtgcagtgttttgttttacgtaaatgttatcactctgttcttgttccataatttgcctttttctctcaatgatttgcttggctatctttctatttcagtagcatctcctttctttttaacttaccattgtttatttaaccttgcctctatcaacagatatgtaggttgtttctagttgatttcattaagtatttataaacaacgcatcagtagatgtccataaatttctttacggaagatggcaagtagtggaattgctgagccaaagaacatgtttaaaaaacccaaaaaaactagacgctaccaattttctctccaaaatggccatacccacttacccatacagagatgatttggaatctggcttcctcacaaggtgagatgccttcacagtttcattcttcctggcatgtcttcccttttgtatctgagagagctggcagaattgtgtcactaaatcaaggatagagggtcaaatgacagctcaagctcacaggcacctctgctttcttcccagaccacctgctttcctgccaccagctctgttccatcttatagaatggttgccacttgggtgtctgctccgacagccatgtcatcctttgcactgcagttatgaagcagacagagctaggagaggggctttgccagcctctgccctagcttggagaatttcaaagaaggagggtattgagagtgagctgccgaagactggcagctccctcaactcaacagttgtccttccacaagaagtcagatacatttttttgggataaaatatttaaaaattattattttatttctgaataatatatttacatgattcaaaaatcaaactgtaggccaggcatggctgcttatgcctgtaatcctagcaatttaggaggccgaggcgggaggatcacttcagcccaggagttcaagaccagcctgggtaacatagtgagaccctgtatctacaaaaatttaaaaacaaaaattagttgggcatggtggctgatatggtttggctctgtgacccaactcaaacctcatgttgaattttaatcctcaatgttgagggagggtcctggtgggaggtgattggatcatgggggtgggttctcccttgctgttctcatgatagtgagtgagttctcacaagacctggttatttgaaagtgtgtagcacctcccccttcactctctcactctcctgctccgccatagtaagatgtgtgtgtttcccctttgccttccgccatgattgtaagtttcctgaagcctcccagctatgcttcctgtacagcctgtagaactgtgaatcagttagacctcttttcttcataaattacccagtctcaggtcattctttatagcagtgtgagagtggatgaatatagtgccatatgtttgtattcccagctacccaggaggctgaggtaagaggattgcttgagcctgggagtttaaggctgcagtgagccatgactgtaccactgctctccagcctgggtgacagcgagaccttgtctccaaaaaaaaaaaacccaaactgtgtaaaatgtgttcataaaagtgtcttgctcccacacctgtccctatatatcttattcctcagcctccgacaactactttattcatttcttatgtatcttccagaatcaaaaaaaaaaaatcaaatacaagcacagtggaatgtattgcccttcttcccctcccttttgttacatcagagttagcatatcataaatacggtctgcattttcttctttttcagctatcagcatgttttggagaggatttcatattcgtgcagacagcatgtattagtcagtccttgcattgctataaggaaatacctgagactgcataatttataaagaaaagaggtttaattggctcacagcttcgcaggctgttccacaggaagcatggcagcatctgcttctggggaggccttaggaagcttttactcatgcagaagacaaagcgggagtggatgtcttatatggcaggagcaggactgagagagagagagagagagagaaaggatgccacatacttttaaacaaccagatcttgtgggaactctgtcacgagaacagcaccaaagggatagtgctaaaccattcataagaactccacccccatgatccaatcaccccacaccaggccccacctccaacatcggggattacaatttgacatgagatttgggctgggacacagaaccaaacaataccagagtgctttctcattcttttctatagctgcctagtattctatgtcctttacttcatttaggcagtctcttgttgatagacacttgggttacttccaatttttcctattacaaatgatgtgcaatgaataattttgatcattttccatttcacatgggttatgtccatctgtgggataaatctccaggagtgaaattgctggatcaaaggggaagtgcacttgtgattttcatagttagcaaattttgttctataagggtcatatcaatttatagtcccacgcgtaatatttaacagtggggatttcccgacagtttgaccaacaaggtctgttgttaaacttttgatttttgtcaatctgatgggaaaatactagtatctcaaagtgcttttaatttgactttcttattacaatgttaagcatcattttactctgcccaagatcaaatagtattttcttttctgtgaacagactgttaagatcccttgcctcttgttttgctggatttttgttcttttttttcaaatgttttgaggcagttctttacatgtgaaacaagttatctctttatctggggtgtgagttacaactacttttcctctggcttgttttgcgctttgactttgcttctggtgattcccgcaattctgaaagtgtactttttgcatcattcattcttatacacccatgctcttgttcacgctggttcctctacctgagggctttttcttttctgcttctatctgggaacatttttttgagagagagtctcactctctcgcccaggctggagtagtgcaatggcgcgatcttagctcactgcaacctccacctcctgggttcaagcaattctcctgcctcagcctcccaagtagctgggattacaggagcccaccaccaagcccagctaatttgttgatttatttatttattttttgtagagatgggagtctcactatgttgcccaggctggtcttgaactcctgggctcaagcgatccacccacctcggccacccaaagtgctgggattacaggcgtaagccaccatgcccagcccatgtgtggaaatcttctgtttatccctttaggcttgattcttatgtcgttctcctccctccttcctggatactcctcttgttctttatcttactctacttgtcatgttaccttgtttctgcttataactagctgcctctcctatctgaggagggacttgtgactgttctcatctctgtactcccagctcctagtacatagcgcttgctcaacagatgtttggtgcattgatagataaatcactggtagctgttactaccagtcctgactccctgcagtgcttcagctgatcctgttccagatgtgcactgaatatccttctgttgaacaacagaaataaaggggatgggtgaggaggatagtcttcggtggccaaggatatttttaggtactttgcagcactcagcaatgaggagtgggctttagtcccccaagaactctcacagccctgggtgtctttactgttcagtgtcaaatccaagacaagtcaatgatcaggaaagaccatttttttttgttcagtgaagtttatttcagaatcattgaacagtatgatatttggtaatttcataaatattcccacttaaaatgatcggagcagatatattttcagtcgtaattaaaggacatgatttaaagagagcacaccagtccaaattgaaatgattccatagctattaaaaaactagggttttttacagacaatgatactttttgccccctttgaatagattagaccaatgaataaaacaaacaaacaaataaataaataaatagggaagcggttgctcatcagaatgtgggagcgaatgacagagggtttcttagaaccaaatgtggccgtggtttctgtcaggcgtgctttaagtgagtaggagaggtgagagaggcctggctcaacaaaagggctggggattgtccctgaagaaccagagctganttncatcaggagtaacanaggtagatagccgcgttgaggttccacgcagttcaaattatgtccaattatcaacattaatgcacattttcaatagaacctgttccggcttttcttaggaggggggcggggagacgttgttctctgggaataagtgtacgcaggaggctgagaaggcttcattccatagcattcacttacctccagctgtagagtgggcttatcatctttcaacacgcaggacaggtacagatttttttctttgaggcccaaggccacaggtattttgtcattactttcttctccttgtacaaaggacatggagaacaccactgaagaaagaagggggtcttgtggttagggacacagcagtgcagggtcaccccaacccctaggccccatgagtaggatacatgtaatttggtagcctctgtgggaacccacagtgaggttccttggcctaagacacaggataacttgacttctcacagacaatagcagggtcattttgttgatttagggtttcccctcaaaggcctgagggtttctcagagcctcatagcagtaggaacggagaatgaaagagggtctacattttaaatgctgaaggaaggaaggaaggaagccattgtgtcactggctggcaatgtgcccatccacaggagcggaacaacttgatcaatgtggaaggaaaggaaagaggtgaggctgtacttctgccagaaatcaggcaccagaactgtttcaggaacagagagtagcccatgggaagaaactgggagaggagaggctgagctgggaaagtggctccaaagagagacactcattttgatcttcctcagtcacagcagtgtcaattggaggccctgggatcactcttactacccgattccaaagaaacaggattttcttggcctggctgagagcaaatagcttccccctgagtgaggctgtccttcaaagtcagcagccttagttgcccacactcctgtgcagaggctttggctactgtggcacgatgccaggcagatcaccacagctaatgatgggttcaccgcacttgaaacttttgcccgttacagcggagagatataagttcctgctgggcggtaaaatttccctacaaggaaccacctggcattgggtgggacggatgttggggcaaggggggaagactggggagggggatggacacattatcgctccagcactcttgtttcagcctcaacaacaggaagagagaacccacaggcagttaggccatgtccatcaaatgaccccatattgtggaagaattgacattgcactatgcccaagagacttgggtggacatggtcctgggagtgcttgagccgtctaatttctcagggtcacactcctgttaacaaatgcactggccagtgcaatcaaatgtgccatttctaggaccaaagtttgtatattcctttttaatattttttttcacttgtgttgatcatttgccttaaattaactttctactttgtttaaaacatggagaattagcaagctgccaggaggccaggcagggaaaccaggatgtttccatttaccttgttgctccatatcctgtccctggaggtggagagctttcagttcatatggaccagacatcaccaagcttttttgctgtgagtcccggagcgtgcagttcagtgatcgtacaggtgcatcgtgcacataagcttcgttatcccatgtgtcgaagaagataggttctgaaatgtggagcacatgttgtttaggtataaaatcagaagggcaggcctcgtgaggcgaggtggcaaaatttgatttcttggaggacacctgagcatatacggtcaaagtctgatgacaacaccagtagggatgaagctgggagtggggtggctaagaacactggacctgacactattagacatgggttccagcttcaggtctattactgctcactgtggccgagcaacagagctacttaggtaaaatggtgatggtcataacactagcccacagggaggttacgaacctctggtgacaatgtaagtgaaaggcccctgagaaagagtgagggagttgcaaatgtcagtagccatcaagatcttctttaagaatagtttccactaaagagatgattgctttggtttccagccttctttgttttgtctccccgctgggccttctacctttaaagggctttggctctgggggaattgagttggctggggcttgatgacttccaagaggacacaagtggagatctactgcctgctcttggctaactaccttcttcaaagatgaagggaaagaaggtgctcaggtcattctcctggaaggtctgtgggcagggaaccagcatcttcctcagcttgtccatggccacaacaactgacgcggcctgcctgaagcccttgctgtagtggtggtcggagattcgtagctggatgccgccatccagagggcagaggtccaggtcctggaaggagcactgcggagagagcgagggagggagcctggtgaggtggtcctgccaggaaccatgctttgacatcagagagtagaaagctcagagaggaggaaagggcttgaaagaatcccgagcttctaaagatcatccctctctgggccaggcgtggtggctcatgcctgtaatcccagcactttgggaagccgaggtggatgaatcatttaggtcaggacttcaaaaccagcctggccaacatggcgaaaccccttctctactaaaaatacaaaaattagctgggtgtggtggggtgcacctgtaatcctagctattcaggagactgaggaaggagaatcgcttgaactcaggaggtggaggatgcagtaagccaagattgtaccactgcactccagcctgggcaacagagtgagactctgtctcataaaacaaaacaaaacaaaacaaaacaaaataaaataaaataaaataaaaagattatccctctctgaagctcaaggaggttaagggtgtactcaagggcacacagcaggttagaggcagactcaagattagaatgtgggctttctgacaccttacaggctattcttttagaataaatcccatttctactttgttcatcttttttgtacatgccccacctacaccatacatgtataccttctctatatctttttgtatccctaatgctgtcacactatgatttgctttttcatgcagatgaccataacattttccattcacctatgctcactcagcaagtattcaatttttctacactgttcttttttttcctttttcataacactgtctcataggcattctgcaaatcctgtgagagtactttttgtgaaatgttaccactttcctcttattcagagaagctccgtattaaggcttcactgaggttgccttaaggcatgataatggttcaaaggcttgaaagacagttaaagagacctgtaagtgcacaaaagaaagttgagcaggagagaatttcctgcctggagcagagccaagctgctggaagaggcaatgggggcaaaggccaggcagacaagccaatgggctcctcccacagctgcagccaacaagttatgccagtcttaaaacttctaaagaaatatgtttttaacaagattgaggactggattatgaggctaggggaggctatcacaaactggaataaaataaagccagagaaaagtggctgccttccaacctgcacaactgacctagctaggctgatggctgggccacctaggaaggctactgagcatcatataaaacagaagggacagcaggaatataacatggctctttgtaaggatgagtctgaaaaatgaccatttgctgcccaaatgcccttagctacaactgaaaatatttcagaactggaggttgcaggatgctggaatctcagagatcatccagctcagccctttatttttcagatgaggtccaaagcgggtaaaatgacttgtcaaggtcaaacagcaagtgaatggttttctttcaagtctcaattcatctttttgtttatatcatctatgtcttgttgttataagcttcaccccaggtagcaaaaaactattctactcaaaaggggtagacatatgttagttctcaagatcatctcttggtttcagagtttaactcaagtgattggcataggctgaatccatctcttaaaaggataatcaaatttatgttgaagacttggttgtcttcctactatgaaatgggaaacattatcactactcctcccctgtcaccaccaagtgtggccaccaccaccaacgttagtgagtgactgtggtgatatgatgaccaagtggccaggtcagcaagtggtgcagcctgtgtctcactggaagaggttaaagtctttctaaaacaaaataccatggcatcaaagtggcccagaactcccttctttgagctttccctgtgttagagcccttccttgggttgggagttaaacccatagtcttaccttcatctgtttagggccatcagcttcaaagaacaagtcatcctcattgccactgtaataaaaacagggacatgtctcaattatgtcttctaaacaggtttatttttccttccctgtgtacaagacttgactgttcataagaaactgcaaacagcctgcctctcaaagctgcctgaaacacctggcaagtttcacagtgatatgcgcagaacagtccagaaggcagattctaggcctggcaggtgggcaccctgggtgctccctgttggatcttgaggcctaacctctagcccagcagagtcagctaaaatctgagctctccctctccctccaagccacactttgcaaagggattccttgtattgtgggcttggaatcttttctccccatttgcctctgcaggaagcccttgcaacaacacatctggatagcctccaggtcccaaggctggagggacttgtaatgggaaagtagtctttaaatcagatttacttggcaccctgtttgccactgaaagaggcaatttaggggaaaaatctggtctccaagcacagataacactctactcttgaaagaggagacctgctcatgttactggtctcagcgtctccactgacctgtaataagccatcatttcactggcgagctcaggtacttctgccatggctgcttcagacacctgtgtaaaaaggagaaaatgagtgacttccccatgacggctacgttcatgtgtgatttctctcagcatccagtgcatggcagtcatgcaaagaaatgatctctgagtaaatgaatgaatgtgtgaaagagaagtcctttgggtctagagaaaagcatttgctaaaccaaaccccaactagcaatgtattggctaggagagctggagcagaggctttgacactaacctttagggtgtcagctgttagataagcagtatccattcccagaatatttcccgagtcataagcattatattacacctggcatttttgcaaaaagctgagagagggaggcagagagggaaggagagggagagacagagaaagaaagagagagagagagagaatatgcatacacacaaagaggcagagagacagagagactcccttagcacctagttgtaaggaagattaaagtcatacttgagcaatgaagattggctgaagagaatcccagagcagcctgttgtgccttgtgcctcgaagaggtttggtatctgccagtttctccctcgctgtttttatagctttcaaaagcagaagtaggaggctgagaaatttctctgttgaatacctgatttcacaatcaagttaaaggaaaggggaaaagagtattggtggaagcttcttaggggaggggactaataaactgagataattctctggttcatggaagggcaaggagtagcaaactatgacacattttgcaaatgtatcaccatgcaaatatgcattgttttcctgacaatcgttgtgcagttgatgtccacattaaaatactggattttcccacgttagaagaatgtttaaatttagtatatgtgggacaaagtggaagacacacagatttatacatgcacatacttttcttcattcacttctttgtacttaagtttaggaatcttcccacttacagatggataaatgggtacaatgaagggccaatagccctccctgtctgtattgagggtgtgggtctctaccttgggtgctgttctctgcctcgggagctctctgtcaattgcaggagcctctgaggagaaaattgacctttcttggctggggcagagaacatacggtatgcagggttcaggctcctgacggagttggggcaaccctggagataagctcacacaaccctgcaagaccaggtgctgttaccctagccaatctcatggatgaaccagatcaatgccagatgagctctgcctaaaatgattttttggtgaactctgaaaagtggaatattgtttctgtaagaatatccatctgagactctatctcttggtaataccaagagttatcagtttctctttaaccgagacaccagcaaagtgcctgctccagggtaatgcccaggggagccctccatttgtagaatgaatgagagtccaggttatgaacagtgcctggagtgtaggaacaccctcctttgcctctttgacaggtctgcatcataacactttttttttttttttgagacagagtctcactctgtcgcccaggctggagtgcagtggcacgatctcggccccctgcaagttccgcctcccgggttcacaccattctcctgcctcagcctccccagcagctgggactacaggcacctgccgccacgcccggctaattttttgtatttttagtagagacagggtttcaccatgttagccaggatggtctcgatctcctgaccttgtgatctgcccgcctcggcctcccaaagtgttgggattacaggcgtgagccaccgtgtccagcctgtaacacttcttatagcactgagttgaaaccttgctcctcctggttcctccaggaaactgaaatctttttgagccaagtctagcacagtgcctggcatgtacattcaggtggtagagtttgctgcttgaatgggtgaatgggaatttgacagcatttttattcaaattagtatgtgccaggtatcgtgctcgctctgcattatccaagggagtgagcctctgtgcaagtatttgagacacgagggaaataggttctactgtgggaaaaagagcatttcatggacttgctctccaagcagccttctgatttttaatttggctcccagtatcttgatatcaggagtcagtcacaagaactccatctttagtaagttatattttccacaggaaatctaaaagctgttcaacatgttagtttcctgtgaatttgataagccataatccattcctaacactgagccctcctgaaatttggtgtctggtcctgcagatagctaaaagccctgtctgggtggcctagggactcctctgttttgcctccacaggatccactttgcaaattaaccactggttctcccgttgtaggaactgccaccttcctcagagcctgtctttcttccttccttccttccttcctctttctttttctttctctctctctttctttcttttcttttctttctttctttctttctttctttctttctttctttctttctttctttcttcctttctttctctttctctctttctctctttctctttctttctttctctctccctccctccctctctctctttctttctttttctttcttttctcttttctttctctctttctttctccctccctctctctctttttctttgtctctccctcccttctctctctctttctctttctctctctctctctcctagacaggatctacctttatcccccaggctggagtgcagtggtacaatcatgcattcattgcatgatcacagcagcctcaaacccttcctcagagtctttatgcggcaaccagcagggtctggagggttggtggctctgtgaactctcctgacagaacacagagatgtctttggtctgttgatgtgattacaagctgaacgaaggaagatcaaagccagtgacaggaagggagatatgcaagggacccgagcatcagctctgagttagtccattctgcttctgggacttgggatacaggtcagaaaccttgagcttctacttctccatcttccaattgtagcatccaggacctcagaatctgccagctaagaggagccctaatgattgtctggtgggatatggtgggaccacagagatgaagacatgaatagctatttgaatgtgaacagcagacgaagaaatcaaggctaggagggtggaagtgactcatccaatagcacagtgtggttgaagcagcactagtatccaggttgcatgagcccctgatgctttcgctcgagggaaattttggagccatggggcaatgccccctgacgtaacagtctccacagttctgccatgtctcatcctggccctgtaacctggacccaaatctgctaccatcccatccatctcaggaagtgaaacctcttatgtcaaataggttgtgcaacgtatgtatcagatcctgtcttcccaaggagaccgctcaggccacagcacttccttccgatccccaatgagcagaaaatatctcgctataaacatagttggcactaagggagggagtggaagagtgatgatgatgtagatggtgatgtagccccaaggaagtggaacaagcagagatggggagctggaaatgccaggatgctccagcttttggggaattattcagctcttgagtcactaaagcctttctcagctgcaagttcctctttaccctgtcaggtcattcttccaagacaggagactgacatttattcaaagcagcaagtgccctgataccatcttgtgtctaatcatgggcttcgcagccagttatcaaggttgatctcatctcattggtcttcaatcattttgaacaagaagacaagcaaaataatcatgggttagttcttatattattgtgtgtacatgcagtgatgtctgttctttgtagtgagctgttccttccttgttcaccctcttgcttagaacagaactaagcaatctgcccccaacattttccccaatttcccatctcattcttggcactggcttcctaatatttgttcttatgagtcattttcttgtatcatttccatgagtccctctgggatcttaaagtatgaaaaatgttgtgtgtacccacacctgtctttgtggatatttctctcctttcccttctgcttctgggattatttgggaatgggcactatgatttttatcatatcgcttccacttcctttatggcatcatctccaatgggcttcttctccctcttggatccaggttctcagattggggacatgcagagtccaaggaacattccattctcctccctggtctagaacaaggagggcttagatatatgagcaggtggctggggctggcgagctatgtagtctccaatggcttttccctgatgtcggagttgttatgtcagttctgggagaccaataagaccttgtccttcctttggatccatcagaaaaagcccctgggtgggtaagatggatggcagggctctcctactctatgtcttttctcacacctagtgggtataagagaggggaccacaaacagagggggctctggtaccacttatccagggtctggaaacattttctgtaaagggccagataataaatgtttcaggtacaactactcaaccttgcatcatttcagaaaagcagtcagataatacataaatgaatgggtgtggctggacttgtcctgcggtcccctgtcttatatcattgtattatatcattttttcttacatacaaatttagaagcaatacttaaaaaaaaaaagccgtcctttattgagcacctactaagtgccaggtacctttttttccctcattatcttattaactcttcataataacctttaaagtagataatattgaaccatttgacctatgcagaaactgaggttgagacaataaattatttaagaccgcacaaacagtaaatgctggaactacgactcaaatatgggttaactgaaccaaaaccagatctttatttctcacttttaattgttacatatgtttattgcctcatctcctgtccacatggtgcccatcggcagactcctttctcattctcagtgattgagtgacattctaaactacattggcctggcagattcacctctgtcccctaaatgtttccacattgtccttttaggattgagatcctctctgttcccttgtcttccctcctttcttcttctggcggtgacgtgctgtgtgaatttgtttctttctcctctcagggtagtactgggactttccaaatcagggtttttagtgatctctcttcccttttctgagtttcttccttattcccattcactttctcatctataagtggcagctttgttgctggaggatttcctttgtccttttattcttctttaagactttgtcataactgtcaaaagcaatcccttgaaggtatctgtccttggaattgtgtgcttatgatgctgaaaaatactctcttcctaaagctattataaatgctggctagctgcaactcttgaatacaaacacattcagacatgcacacactttctggctcccaaaaagaaaaaaaaaaatcaatttataataattctgatcctttgcttatttccacaaactccatgaaaattgtacattgtccaagcaacatttcttaatattctctttttctctcatatccattttccttactgctgtctccacctatctcttccaaactccctgttaaaatccctgccccagcgaacttttattcaattttgtggaatggaggctgcactgatttaaattaaaaaaaaaaaaaaaatccctactccatgtcccagatccctagttgttttttgttttttgttttcctgagacagggtcttgtgtcttccatgctggagtgcagtggcatgatcatggctcactgcagcctcaacctcctgggctcaagtaattctcttgcctcagcctccccagtagctgggagttcaggtatgtgctaccatgcctagctaatttttttcttttattttgtagagacacggtcttgccaggttgcccaggctggtctagaacccctgggcggacgtgatccgcctgcctcggcctcccaaagtgctgggattacaggcgtgagccactgctcccggccttgggtgcaaatttgagctttctcacttattagtgtaagacatacagctaatttctaaatcttccaaacctcagatttttcatccatgaagtgaggattattatagagctcactaataacatggcttcaaaaatatataatgccaaaattgagatcaaaataataaatctatattacatgggagatcttaatgtacctcttatattattgatagactaagatgatcaaaaaaatagaaagagagcagtaaggagagcaagcatttaatcaataggaccaatacattttaatcaataggatcctcaggaatatatacagaataccaaacctaacaactgcagaaaacatgccaaacatttaggtacagacattgttggaaaatgcaatcttgaaacgagtggactgacattcagaagatattaataagagcactaatgatggggattgcaaccatgtctttactgacttccagaagcttcttacagtaaacatgaaatcacataatttcttccactttcctactgtttcttgttctgggctctgtcctgcttactgtctaatatcttggccccttaaaagttgctaatcttccaaacctcattcctgtgactgggccgctggtccttgttcatgggccttgaaaatactgactgtacacttatctggagcatccagtgcctaccacctgacccagattcctcattgcgctcctccctcctccacctattggaatttgctcatacccgtgtgagacccctccctttccccccatctgaatttttatcaagacaacgcactgccatactccctcgtaccctgctctgggcatcagactgaatgtttgtttccattgaggatctgcagctgcatcagtttccccagcaccgtccaaccccttgagcatggctagtcctaaagcagagaattagcctttctatccctgctgctatacatgctgggacaaataataagaaatgacagcattttatgataatgcaggctgcaggaggcaggaggcaggaatcaaattcgtgcttatcaaatagtgctccaattctttgaatattggactatagaatatgtcatggatctatgctcaggtgggttccctattactcactccactgaggccaggttgtgggattagctgtccaagagggagtttcagtctcacagcatagggtcattctgagaattactggcccacacttgtgtggagacctccagagaacagaatctgggttggtgccatgtacttccaggaggagagaagtggcaggatgcccagccccacaatcagaggggaaggggcagagccacatgtatgaagatcctctccccagtacgtgccaatcacagggcttcctagcttttgggccaaggaaacaatgtgggaagcaaaaaaggacaattttctcctccctttgcatgaagactgagcagttttaccagattcccagggaaacacccttccactctgggttgaatgtgagtgagagacattcagctggaacactagaaaaactatttcctgagccactcacctttagccctagaaagtgttggatttgtccttcatctttgccacagtagagactgctgatagcatcagaacttgggctctggaattagacagatatgggtacaaatctgagctctctcacttattagtgtgggatgtagagcaacttttaaaatccttccaaacctcagacttctcatgcatgatgtgaggattgtaatagggcccacctaataggggtttttgagaattaaaaaagttattcaatgaacagcatttagcaagatgcctgaccattgagaaaataacaaattgtttattattattgttattattaaacatctttcctgcaccttctgactgggggcatcgtatcatcagaaatacttaggatgggatggattcctgcatgggctgagtcaagggtgcaataatggaggagtgaagaaggaagaaatggaggcagaaatccccaggagcccagcatggtacaaggctgagctagtgctgcagagcctccttggaacagccacagagcttgcatctggccctgggaggaacctcttctagctggcaggaccagccacaacagtggccaggggatttcccagggcgtgggctcctaggagttcatttggaccaagcctgcctggagaggggttataacagggatccttccctactggcaggtgatttacccctcggtgagaagctcaggcatttgtttgatggaaggtggaaggccctgtgctgggccagtgactatcagggatgggcgggtggctggaaaatagcaaataagacaatatgataacacagttaaccaccacactatgtgaagctacaatatgggtatctgtaatagacaattccaatgtagagaataattctaaggtgtcattctccccgccaatgccataagcacacggcctctgcctgggtttctcactgtggaatgtcctcctggtctcctcatgcccagagagtgggaagtactcctactttaacaccggctttcctgtcatctccctgcagccctcctcagccccctctgcacagggaggtttcctccctgctgctgcagtgctttgtacttgttagtggtacctgcacacaggtattggtgtccttgtctcaccaccctacatcactgtaagctccccaggagcaggcttcctgtttgactcacctgtgatcctccacctcccaccctgtagtgcctcaagcattgaggacaatcactggctgccccttaacccagaaatgctgccgagacaggaggccatggcccaagttcctggaatggggtattactatgtcagcacaaaggcctttgcacaaatgaaggctttaaaaatgcagtcctagtcaggtggaggagggcttataggattcccaggaatctggatcattctcttgagagctttcccttgtctctgttaaaactcacatcctacggcccaaataacaacaaaaaatggatgtaaattcttgaaataacttgtggatgggggaacaaggcccaccccccagatctgccagaagcttcaggtgagggtcccaaatgccaaaaagtctggtatcagagaggatggccagtgacctggggacacatgccctttgctgtgtcactcaaggagcagcagcctcggccccgcacagtgaccaggaccctggcttcccacgctgggcaggagctggtgtctgatgaagggaatgcctggcagcacgtgctgtctgtctcctcgtgtcagcttacctggctttgctgcgaagaggccactcgcatttctcaattttttatatttttttaattttttaaattttttattttatttttatttttatttatttatttatttttaatttttttttaattttttaaattatgctttaagttttagggtacatgtgcacattgtgcaggttagttacatacgcatacatgcgccatgctggtgcgctgcacccactaactcgtcatctagcattaggtatatctcccagtgctatccctcccccctccccccaccccacaacagtccccagaatgtgatgttccccttcctgtgtccatgtgatctcattgaatttctttaaaggtggaatctctcagtggggtctaatctgttcagaaatatcaaaagagtatccttgggaatgactggaattccagagtcatctggtaatcctcataaaacaactcctggatgtctctcagcacatctcccaccttgaacgcaggaggctggttcaaatggaggagcatcgctctactgcacttttttttttttttggcctaaagtgcaaaaggggatacgtttcatgtaaataaatcaactgcaaatcgctagttatgctgagccctgtcccgtgctgtggacacaaaggaaccaaaggcttttctccccgcccaacacacacataacacacacacaaaatcataaaaacatacatacccccaacacataacaacacacaacacacacacaaaatatatacacacaacacacaccaaacatgcccacaaacctgtgtccagagatagatcctactggtgggtttgtggtctcgctgacttcaagaatgaagccgtggaccttcgcagtgagtgttacagctcttaaagatggcatggatccaaagagtgagcagtagcaacgtttactgtgaagagcaaaaggacaaagcttccacaacccagaaggggaccccagcagggttgctggttggggtggccagcttttacttccttttggcccctcccatgttctgtttccatcctatcagagtgcccttttttcaatcctccctgtgattggctacttttagaatcctgctgattggtgcattttacagagtgctgattggtgcgttttacaatccccttgtaagacagaaaagttcctgattggtgtgttttacaatcctcttgtaagacagaaaagttccccaagtccccactggacccaggaagtccacgtggcctcacctttcaactccataatggcatgaaaatacatatgttgtacaaaacatacatacacaaagtatacatgcatctccccaaatatacacataccacagaaacatacacacaggaactcagctacctgtcaaaagtctgcatggtgattgcctctgcagtgagtagttagaaaagtgaatttgtttttcaataaattggagtccttaaaaatcgttgtaagatagaaaatttttaaaagtatataaaataaaatatgtatgtcctttggtctagcatttacacatgtaggaatttatcctagtggagtaatcaatgatatatgcaaagatttggacaagcatattaagcacagaattatgtatgcatatgtgtgtgtatatatatatatatctcatacatataataatgtaaaagtgaaaataactcagatgttcaaaattgaggattagttagactatgatctgtccatatgtgacatacaagttagctgccccttattctctcgagcttcaacctcctataaacagtgtcccttgtatatcagtattggtacagataatcgaacttattgaggttttacatggggcaataaaggcaagagtttatgaatactccatactacactaggtagcaccccctattaaagacaaactcttctctctcatttcccttcctttccggaaccacttggttgaatctctacaagtctctattgcaactgcctcaacatggcaccctccctgcatctccatcttccctgtcctgagagcaatggcctgctgcccccacactcacatcctcattcattccagaagtgagcaccacagaagtgcctacagttaccccaaccaccttcttagaagataagttagtgtttgttttgactttttaaaatttttacttcctcttttccttcacaatctcatcccatcccaagaggtttatcaagaagttctctaaagatatgtgtctccttatggaatttaacagaaatcagggatttgtattctagccatcaagggaataacatttttccaggtctttagacaaataatggaataccttgcagtaattagatacactattgtagaaaagtattgatgaaatggaacgatgtttgagatatcatattgagtagaaaaggcaagatacattaagtaggaaatgtatcttacaaaataatttgtcagacacactcctatatttgtatgttatataaatgcgtatgtgaagaaaggctagaggatgagaccacagtcttcggtgaagtttaagagatgatgctgcagcatgctcagaaaggcttggtatagttttttccagtaattaaggactgatcttaggtaaattgtccatcctctctaaactgcaccaccttttgtctgtaaaacaggaaggatggtatttacccccagggtcatcaaaggatttggttggagaaaaataaataaatgggctgagcccagacctggcacagtgagagcacagtggttgactattgtgctggcctgttgttcctgtgttattgacatgctgctggtggtggtccagaagctattaccttaattggttatgtggatttcccctcatactgagcagctgtgtgtggtgttgtaaaacatagccatacacagtaactgacaagggcaaatgtgatggaaaaatgcaaggaagtgcagataaatagctaatgggctgtagaaggaagctagtccttggagggcttgatcaaggaaggtccttttgcatgtcacctttgaagaagaggggacatagaagaggtatagtgcatcccggagtgtacctggaagggaacatgaaaagaggacatttttctctgggacatggggactccacttgcatgaactctggaattggggcaaagaaccatcatgagaacaagggcttccttgaacctcccaggctcattggctgatctaaaccctgtgtcccctctttccttcactctcctctgttttctatacctgtattattggactggactggaagccacctgatctatcacaagtaccttgaaatgtgttgaataggtgtggcacagtccttagcagagtggcactacccccacaggaatttgtttatacctttggcatggaaaatagcaggaaatgagtgatcactgataactgaggatgctatttattattggccaaaggaatacttgtgttgtatttgcataaccactcacaaactgttgattacaaatgagtaccagacctagctccttcaagtaaaggatcttgagaactgaaggcaaacagagctccaggagtccaagacagagccacagaccacgaggatccctggcccaggtaggtggtcctcctgcactggctttcaaggccaacaggatggatggggaagtagagtagcatctggccatctagacccttgctttttatccccactggaagcacatctgaatttctaaatatgatctctgagacctgcccagaacaccttgctctcagccccagtagcagcctgctctctcccaggagggcttccactaacaagtagggcattgctggagggccaggcagacactagcttaggaaatccaccaaccctggaaatgctagtcccttctctgaaggctcagaagactgactttagagtctagaaaatattggtccttgggaacagattttgagtgcaaagagatggacttcagatggccagatgcactgcttctttagggaattctgtgaaagctccctgcatttatcttaatacaggcagcagatttcatgagtacccccgagggatggccccaggtcctccagcctgtgagcatccttctgtccttcagcagcaccacagtatctttatatgtctttggatacctacgtttctgccagacatctcttgctctgatgttctggctgccaaattctctgtcaagcgcctccaattttttgtgtcctttgatttaccccaacatgacaaaggcagttgtgcttcatgtattcagggatactgccaaaccacaaacaggttaaaatcaaatagcagatatccctgttcctaaagacccatcagctctacccacctgctcctgctcaccgtccttattgttgagtcctgaagcccttccttgtcatttttattttttgcatgaacaatttagttccctttgtctcactcctaaacctttctcaaaggattggatttgtacacaaactgcctatctctgcaatcttagaagtgatatgattctgaacaaatcacttaacttttgattttttattggtaagatgggaataccaatttttgctccacttctgtcctatgttggcctgggctgatgttgaaagctctcggtcaactgagatagggtgtgcagaatttatatatataaatatatctcctccaacccctcccaatgaagcaagtcacgtgagtcaatcctaccctaagatattagggattgagcctcctgggacatttggtggcttaggttttcatgaaaagaggttgcagagcaactgctttttgttaggcaaagattaggctactgcagagactcagcaaacttctatagaaggtgtcagatggtaagtattttaggctttgcttgccagatgatctctcaactagttaaccatgctattgtagcctcgaagcagccagagacgatctgtaaacaagagcatgtagtgttggcataaatatagtaccgcggcaataagtctatttactgtaaagttaatcaaatttacatttcagaacacttaatctgcaagagtcctttccaagaccctatacctaattttgtgtttacaattttatatttgttttcttaaagaagaccaccaatataaactatatccagccttcatgataagtacataagaaactatgcaaataagggggaaaaaaaacaaagaaaaatacctagtttactaatggttcacttctgaatagcacatattcataatgatacaagcactcattactagtctaggaaaatgaagatataattgcattaggaagatcaagaggtaggaaatgtggatgtgtgtggtatagactagggcaggacaaagaacctaaatcctcattttctaaagataattgttaatacgtaaaactcaaaattcaagaagtaacagtaaaagcggtcattaagaaacaagcactaaacaccagataggaagcgagagatgggggaagagggcaagaatctgattattttttgcaacaaattttgtaaaaccatttgactgtttacatgtagaacttggatcttttttaaaaaacacaaaataataatactattattttttaactggatttttgaaaaagaagataaaagtctcattttagtaattaaaactcattccaggttagtccactcaaaacttatattcgaaaattaaaactttgggaggctgaggcaggcagatcacctgaggttgggagttcgagaccagcctgaccaacacggagaaaccccgtctctactaaaaatacaaaattagctgggcgttgtgcatgcctgtaatcccagctactcgggaggctgaggcaggagaattgcttgaacccgggaggcagaggttgcagtgagccgagatcacaccattgcactccagcctgggcaacaagagtgaaactccatctcaaaaaaaaaaaaaaaaaaaaattaaaacctctggaagttgagtttgcagatattcattatgctcatttttaacttgtatgtttggaaaatgtcatgatgagaattgaggttgggggatgagaaaaaaagaaaaacatcaaccccacagcccattcaattttcagcccgacccacagctccggggaagggcagcaggtccatccttcactctttcttcacctctttcccctccttctggctcttccacctctaagttggagcccaagaagaggcactgggaaatggaaaagtcttttgtacgtggtacttgccggggaagctgccatgaagacctggccccacggtggggagggaatgcccagctgaggcctcgtgcccatgctaggatagactcgtccagacatgtcaggtggtctgacagggcaagcagcaggaagtcatgtatgagtatgaactgatctgtatgcaagggcggggagaacacgcggaggaatggggcgtgagaaaacagcacagtacgtttctttagcagctgtctctgctcagccatgggagtcaccagagaaagaggcttggaggcgttattttcactgtgagatgtgagtgtaaaaaagtgcccaagacacagtgagtaccagggagatgccctctttccctacccgaatgcagaatggccacaggccttaaaacacacacatggttcctcagaggagagaggcctccacagtggacacccgcattctcccctggtcagcagcagcagggcgagtgctgggccatcatgaagcttcacaggcaatgagctctcagcaataacaggaacagtgcctgggggactgtagctgcaagaccgattttcatgtaagatggcctctgaggactccgagatacaccaggctgagactagctggcagctccaagttcttggtcagaagagaacaggaactagggaaattggaattactgttactacaattcctttacatccgcacaaccatgaggtccagagagtctctcttattttttttttaaagacagggtctcactctgtcgcccagcctagagtgcactggtgtgatcatggttcagtacagtcttcacctcccaggctcaagtgaccctcctgcctcagcctctcaagtggctgggacagcagttgcatgctaccaggcctggctttttttttttttttttttttttttttttttcggtagagactgggtctctctgtattgcccaggctagtctcgaactcctgggctcaagtgatcctctggcctcagcctcccaaagtgttggaattacaggcatgagacactgcacccagccagtatagtcttttaacagctttattgaggtacggctaacattgaaaaaactacacaaatgtaaagtatgcaatttgataattttgacaaatgtacacaccagtgaaactatcactacagtcaaaataatgaacatatccatcactcccaatttcctcacgccccttggtaacccctctctcccaactccctgccccctaacatcagacaactactgatgcattctgtctccataggctcatttacattttctagaattttacataaataaaatgacagagtatatactccttcatgtatggcttctttcagcccaattatgtcaagattcatgcttatggctgtgcgtatccttagcccatctctttgtcttgctgagtaggataccattgcatagacagaccacagcttgctcatccattcactcttgacaacgttgaattgtctctgttttttgcaatgacaaataaggttgctatgtacattcctgtatagacatttgtaaaagcacagcatttcatttctcttgggtaaagacctaaaagtggaaaggctgagtcatatggtaaatatatatgtctaactttttaagaaactgtcaaactgttacccaaagggattgtacaattttacatccccaccagcagtgtatgaaaattcccgtacttccacatcctcaccaatatatggtgtggtcaatctttttaattttggacatgntaatgagtgcaaaatgaggcccagagtgtctgaagttacatttgtatcctttttggcatccaaaacaggtgtcaagcatagaaaaaacacttgttccttgaatggtcagtcatttacaagtggaattcattacaaaccggtagttctactgggttaaactatgccttactgtcaacaggcacatacacatacagacagacaggaaggcacagagacaaggcagagcattgataagaaggtgacctgggctctagctctggcctatcacctagtaaaatattagttaagtagccatgagtaactcacttaacttaccacaggctccattttcttatctgtaaaataggaacattgaaacagctaatccccaaggtttgtggataatcagaattacaaagatcaatgacatttctatgagagaaacatatttccaagtatttgatggagtacatcagacacaaaggaaaggaaactgaatatttttgaggttttttttttttaccaagaaattcacattttgttaaattttcagaactacctcctgaggaaagtgtagctgcacccatttagaatgatagaaaacatcaatctgtctgattccaaagccaagttcttgctacaacgagaaatgaaacaactggatccctacagatgcagagacctgggccccacaaatgtgaattctgttcccctaccgaatagagttacagttccataatacagtactccctcacttttccacagtctcacattccacagtttcagttacccacagtcaactgcaatccaaaaatattaatgaaaaattccaaaaataaacaattcagaagttttaaattgtgctccattctgagtagcgtgataaaatcttgtgccaccatcccacctgtccagcttatcgttagtcattgacatcgtctgctcctgacatccaaccattgacatcatcatgactctatgatccaggatcaccgaagcagatgaccctccttctgacatatcatcaggccaatatcagcctaaacactgcatcactatgcccacatcagtcacctcacttcatctcatcaaggaggcaatggatcacctcacatcatcacaagaagaagagtgggtatagaacaataagataattttggggcaggcatggtggctcacgcttgtaatcccaatactttgggaggccaaggcaggaggatcccttgggcccaggcattcaaaaccagcctgggaaacatagtgagacctcctctctctgcaaaaaaaaataaacaaaattatccagatacagtggtgcatgcctgtggtcccagctactcaggaggctaaagtgggaggatcacttggtcccaggaggtcgaggcagcagtaagctgtgatcgtgccactgcactccagcctgggcaataaagtgagaccctgtctcaaaaaaaaaaggtaattttgagaaagagaccacattcatacaacttttattatagtatattgttagaattgttctatttcattacttattgttgttaatttctttctttgcctaatttttttttttttttttgagtcggagtttcactcttgttgcccaggctgtagtgcaatgagacgatctcagctcaccgcaaatcccgcctcccgggttcaagtgattctcctgcctcagcctcccgagtagctgggattacaggcgcctgccaccatgcccagctaattttgtatttttagtagaggcggggtttctccatgttggtcaggctggtctcgaactcctgacctcaggtgaggcctcagcctcctaaagtgctgggattacaggcttgagccactgcgcctggcctctttgcctaatttataaattaaacattgtcacaggcatgtattaatttataggaaaatcatagacatatagagttgggtactatccacagtttcaggcattcactgaggggcttggaacacgccctcctcagatgaggggggactactgtcatctcctcaatcattcttgattcaatcctcaacacaaatggtttggccaggtcttgcctctggagacaaaattgctaaggatttagaggggaaaaaatgtagttcactgggaaagtcacctctgctccactggacagcaacttaaaacccaggccatgacaagtagaaaggccacccccactctccttcacacctggagtattcaggagtcaatcatatttcaggaccaccaggagcaaactgggaaaaactgagctgccttgaggaaagcaatcagctccacaaggggcttaagaaacaagctctgggaggagtggttggagaagagttggggacacatcagaaatgccatcaaatttctaagggctacctcgtggtgtcagacctgtgcatcttcaaggacataaacagatgggataagcagatgagattcacagaggacatcaaaatattggctccccagaagggagaacattctagtaacagagctgcccagctgcagagtggactgtttcacaaagcaacaggtgccctgcctcttgaatcaccatcttcacaggaatgcagtagaagggacttaactcctgccctgaagaaaaggttaggctagggaaacagctccaaaattttttaaaaggaagcaacataggcatctactgggagttttctaaagcctttgtttaatgaaactaaagagctgggacaggaaatgccaaattaaattaatagagccttgctttaagacaatgcaagtggatggtaatgaaggaatgagtcttaggccttggatcaaccgtattaagcaatgctgagcatggagccaattctgttcactagatttgctcagaaagggccagacgagaaggatttttctaaaggcacctactaccaaaaagctgccaaggcgtccaatggagcccagagagaatatgctaacaataaaaagttgaacaccctcaataaaaaagggtaaaagtaattaatagaaaattactgaaagcttttttgaaaccaaaagtagtcagcattggtaaaagtctacaaaagtggacactttcatataatgttggcaggagggtaaaaagacataacctttttggaggacaatttggcaacagagtaccaaaaaccttacaattgaagagaactttggcctgagtgcagtggctcacacctgtaatgccaacactttggaaggccaaggtgggaggattgcttgagcccaaaagtttgagaccagcctggggtaacacagtaagacctcgtctctatgaaaaataagaaaagttagctgggcatggtggcatgtgcctgtggtcccaactacttgagagactgaggcaggaggatcgcttgagcctcggaggtcaaggctgctgtgagccatgttcatgcgactgttctccagtctgggtgacagaatgagaccctgtctcaccagaaaaacaaggcaagagagagagagagagagaaggagagaaagaaaagaaagaaagaaagaaagaaagatggaaggaaggaaagagaagaaagaaagaagaaagaaagaaagaaagaaagaaagaaagaaagaaagaaagaaagaaagagaaagaaagagaaagaaagggagagaaagaaggaaggaaggaaagaaagaaagcaagcaagcaggaaaggaaggaaggaaggaaggaaggaaggaagaaagaaaaagaaagaaagaaagaaagaaagaaagaaagaaagaaagaaagaaagagaaagaaagaaaaagggagagggaaagggaaaagaaaaggacaaagaaaagacctttgaaccctgaatttcacttttagagattcatcttaaggaaattcattccaatagaaatttatccccaggattatctaaatatttgcttttattttcttctagtaattttatggtttaactttctcatgtttaagcctttaatttatttggaatttattttggtatgagaaagtgtgacctttttttgttttactttaaaaaaaatgtattacgattattattttagagacagggtcttgctctgtcacccaggctagagtgcagtggtgtgatcatagctcactgcagccttgaactcctggcctcaagcaattctccctcttcaacttaggagtagctgggaccacaggcatgtaccaccatgcccaactaattttttttattttttgtagagacagagtcttgcttgttgcccagtcttgcaatgttgtctcaaactcctgggctcaagtgatcctgtcgccccagcctcccaaagcactgggattacacgtgtgagccactgcgcccagctgcctttttattttttaatttttcagatgctttgttggttccaaaatagcacttattaacccacgctttccccctctggttttaaatactgcaagtttggctttgaaatacaacccactgccttattcaggctacattcaaggaaatctgagaccaagagtctgaaggcccagtttccttcctcaaacccaggaggtggtaaatgtgtcacttccacactttctatctatttctaagaactccttctttccaaactctgacatgcccctggctcaggtctatagaaattcccagggtccacagacaaagcagaactcacttatggggaaatctgggaaatacttatctgttaaacctgccccatatggtgactcagattgtctaaagcccaaagcatcattttccaccccaaaccatttcctcctccagacttctctatttctgtggtccagagtcaagatcttgatattaccctagagtcccccttctgctctcctgcatacccagatgcccctccctccccagatccattctcccaccctccctcccatcagtttggtgggcccatcaccgcttcccctggcccaggctctccttttgtgcgcttggagcagcagactgatctcccagccttcactcacttcatgtggtaatctgttgtgttcatcactgtcagaatcttctgcatcccctcactactctgctgaaaacactctagtggttcctcattgctcattaatgaaagtctagatattaaacgtagaaggcccagcacaatttgcccctatgccacctacctctctaatcttttctccttactctgacagactctccgtctgtcatttatgtattcttttattgctctcttctacttttagtatgaactggatttatggatttttttaacattgctttcaagtatggaataaagaattttatttatttatttatttatttatttgagactgggtctcactctgttgcccaggccagaatgcaatggtgcagtcatatctcactgtaacctcgaattcctaggctcaagccatcctcctgcctcagcctcctaagtagctatgactacgggtgtgcatcaccacatctggctaatggaataaaatattacaatgcctaatcttaattttcaaaattttaaattacattgtacctaatgcccatgcatttacttttttcagtgggtcaatagccctcactttggcaaaggtcccaggcccaaggtaaggccttactttttccaaactcatcttttgaaagacataagtgcctgtaagttgtaccacattaggttctaggaatttttcatcaaagactttatcagactattttcctctaagttgagaaagagctgggggcagaatatggcactgaatgactgaagagaaggcactgaaatcaggccagaggttgctggaaagagcaatgaggaacaccagcagcaatgaggagccggtgatgattttggcttcacagggaggtgtgtaccacaccgattttatctctacgtggatgaaccacagctgtcggctcccttgtctccaggacatcacactctccacattccctcccatcttccggcttctgcttcccggggccctcatctgccccatcctgggtgaacactggtcggtcaactgctgggcgtaccttcccgctctgcacaccctccctggccaccccacccactctcacggctcgcactgcagaggagccgcatctctagctccagcccatctgcctcttctgagctctaacttcatgtaggcgactcctgccggtgttgcctcacaggcccatcatacttcaaagcattttcccctcagaacaccatgtcctggctgctccctccagaagatacatctctcaagcacatccccgcggctctcacctggatgactgcattcaccttctcccacatttgccctcctttggatgtatatagattgttttaaaatacaaatctgatgtgcttgctctcctgcttgaaacacctcaaaactgccttcaggataaaccactgcccttgacatgttcacaggttgcccatggcctggccctgcccatctcttcagcctcatctcatgccccttgcccctcgctctctgggcttctgcctccctagccctcctttaggttctctaacacaccatagtccttctagtgttggggcctctgcaagtgctgttcccattgcctgagacatgaatccctctccctatctctacctgcaccttcatctgattaatccctacccttcctactcatgatgttgctttctcagggactctctctgactttttaaactaatcagggtctccccagtatatatcttcatagcactctgtattactcctttcttaatgaccacctgctgtagactgaatgtttgtcttcctccaaaattcatatgttaaaacctagccccaaatgtgataatatttggaggaaggctctttgggaggcagagccctcatgaatgggattagtagccttataaaagagacccctgagggctcccttgtcccctccaccgtgtaaggatgcaacaagaaagtatggtctatgatccaaaaagcagacccttgccaggtacccaatatgctggcacttgaacttcccagcctccagaactgtgagaaataaatttctatttttcataagccaccgagtctatggtattttgttataggagcacaaacagactgatgtgccacccaaccatgattatacgtgtaatttatggtttctctgctagtagggatgcaccatggggttaggaaccacgcttttcttatttcccacacagtccttagctctaagcatgttcctgaatcaaagatccccatcttttatgaatgaaggagtcagtgaatgaattaatgaaagaactgataaccctcaataattattccagccttttatacctactattaacaagcttgcattctactccaaatttattgggctttaactctatttttggccagccacatttgacattccctgaagtaaatctatgctttccatcctaagtcaaggaaggacctggactagtagggccaagaaaggtctaaattccatgggtgggagagagagactaaatctgaaaggaagaatagattgagcaaaggtgtagagattggggaaggctggacatttggagagaaggaaaaggaaactgacactaaaccaaacagtctcacaaacacaatctcatccttccaaaactctgtgaagtaagaattactatcccagggccaggcacagtggcccatgcctgtaatcccagcactttgggaggccaaggtgggtggatcacctgaagtcaggagttcaagaccaacctgatcaacatggtgaaaccccatctctactaaaaatacaaaattagctgggcatggtggtgcacacctgtaatcccagctacttgggaggctgaggcaggagaatcatttgaacctgggaggtggaggttgcagtgagcagagatcgtgccactgcactccagcctgggtgacagggagactccgtctcaaaaaaaaaaaaacaaaaaaaaaaccaaaaaaaaaacaaaaaacaagaattactatcccagttttgcagatgaggcaatggaagctctaaaaagttaagtaggagaaacaaacatgaaatgtatgtcttatgcttttcctcatcctatttcctcagcctggaatgtccattctccctccactatgcaaatctaactcttcaagctaacacatagcaatgtctgagaaaccgtccctgtgttcactctgttagcctcacttgctccctccccatccctctgtttcctttctgttataacacttctctattctgctggcatcacagtcatctccacctgccttcctcacaagttaaaagcttgttaagggcaagtggtgttctttgccacctcattccccagggcttctaacacagtgcctcatgcatgacagagttgtaaaacaggttaccaagctggcttcaggcaggtttgcatggaactgtgctttacaggaatacctgctccccccaggccctgggtcttcctcctgagtccaggctcagactctctcatcctgctcgttctctcttggggagccacagtaactttgagcaactttgcatgggatagaatggcctattaggggcagcacaaagaccccatggagggaagagtacagaaagggaaaacgataatcatatttttttaagatgtgcattttcttaacaaaatgctctagtacttgtccagactttcaaactcaaaaacctaagcgtccttttcttgaagatcatcaaaggccccagtggtccttcaggtatgtcaagctttctagaaaataaaggtaagtcataatcacttaacacacatggctaaatggccatttccttctaatttatcagcaactgttacatatttctatactagaaaaaatttatatttatactcagggtggtaagttaaatttgccatcgaagtaaagcagaaagagcgtagcatgtatgtatatgtaactcaactgtgcatgagacaaagatgtcttgaggagaatgagtctaagatgcgcctgagcaatagtaccc

SEQ ID NO: 87 - DNA, 176373 bp, Homo Sapiens
  misc_feature (1)...(176373): n = A,T,C or G
gcacccatgtttctaaagggcataccagccataataacaggatgggtgaggatatagacagcagatgacagagaggagagtgaaagctgggaatcccagctaaaggcatcaggtttatggaatgagtaggggacaatactgtgtgtgtttatacacacatgtatatgtgtgtatatgtatacatgtttatgtatatatataattatatggtaccatttctaattgacaaaataatctatcacattttacattatcagattttacatctattgttctaaatacactcagtcatcagccctgtgtgtgggctcttacccatccccatgcacacctcagctcaaccactgatggatggatcatctgcctatcagaggtggcatattcaggtgaatccatggccacagctgcagcacttcctacccacgcagaaaggctccacaagaggaggcacacccgctctgactgtccctaagctcctgacatcttcaccccatgaaactgctgctcctgggtgcttcctgccttgccctgcccacccttgtactgttctcaccattgacacagctggtgcccgatgcacnaaaacgaatcgtcactattgaagcctgtctctcancggatcgtgactaagaaccccctccttgcttcaagttgtcctgcctttctaggcagagccaccctacatcttaaatatattgattgatgacttacgtctccctaaaatatataaaaccaagctgtgctcttaccaacttgggcacatgtggtcaagacctcctgatgctcttgtcatgagtgggtgggtgttctcaaccttggaaaaataaactttctaaattaactgagacctgggtcagatttttggggttcacagcaacaatttaaaaaactcaccattgacctgaaattttgaccttatgctgttcctcacactcctccatgaaaatagacgccatcctatgagttccctcagccatgtcatgccacacttccaacatgtgtccccatccaccatctgtcttcttattgctgcatcctacccaggccctgatctctggacccattgttgtataattaagaatttggggctgggcatcgtggctgtggctcactcctgtgatctcaacattttgggaaggtgtattagtcaggattcctccgaaggatgcaaccctagggatcctctctatgaccctatgtctacgcgctcaaccgaccgatttgcgcgaacctgcccatgcccgaggacagtgtaatcctaaaacgtcccctgaatcataaggatatgagtgcgaaagtacggttccctctgtcaccactttctaacaacgctatgtccgatccgtgcactaaccccgcccaagtcactgaaacactgatgggcgcttcctctacaggtatccagggccaataccactactcccctcctccctgtcccccttccactctctagaggccgcggatgccatcctctattagcacaaccgaaaacgacggtgaaagtaccacgaagctcacgatctgatcggtcgcccaatgcggttacaacggctgtcatcccaacccccgtcccatcctccatattgcccccccctatgaggatggccctatcatcatgacctccaaaattctgtcatctcccgacgtaatgccgcccctcgaacgcctgacaccatcaagtcngtcacctcccaaaatactcctcctaatcaccaggccgagtatccccggttccacaatacctccttgagacgggccgatatcacacacnggagtttaggtcaactagtaacaagtgggatttgcgactcaggtctatctaatcctcaaacccacgtcctggacccctacacagactgccctccctcagtcctctgtgtggcctcaagaagggtctggacattcaagtttaaaaatccatccaaagaatctatggacccagtggtctctggagtcaatgttctgaggctcagaagggccaggcaggagggagccgcctctacacagtcctgagcagagtgggctgtgtcccggcacagcaggggagatcataaacagaattctgccctgggccctatttaagtaggacctttaggctgccggtgtcatgaccacaggtcccangtctgcacgattggctgtgtgtggaaaatcttcactccttgcggccttgtccttggcagagagcaccgctgcttcctctgatggccaccagggggaggcgctcccctgggaacggtttgaangggagcctcaccccacacgtgccttccgtggtacccagcaccagctgctacccatggttacccacaggcccagctctgctctgaagaaggaggagtggtggcgatcangccttgtctgcatcccgtggctgcccctttcttttctttgggagctaaccgctcactgggattacaggtacgcaccaccacgcctggctaattttgtatttttagtagagacggggtttctccgtgttggtaaggctggtctcgaactcccaacctcagttgatctgcccgcctcagcctcccaaagtgctgggataacaggtgtgagctaccatgcctgggcttatatgtttctagtccaaacatttagctaccttttttttttttttgagacgaagtctcactctgttgcccaagctggagcacagtggcacaatcgtggctcgctgcagcctcaacctcctcaggctcaggtgattctcccacctcggcctccctagtagctgggactacaggtacgcaccactacaccctgctaatttttttgtttttgtattttttgtacagatggggtttcttcatgttacccangctggtcttgaactcctgggctcaagcaatctgcctacttcagcctcccaaagtgctaggattacaagcataagccaccatacccggcctacctacttttaacttgtggaattttctataaggtcanggatgcctgngggaacaaaagtttctcccttggtatatgcaagtaaaatccacatgctgcctcccaggactgtagctgttgtctagtcaccaggctggactgcttggcatgatctcagctcactacaacctccacctcctgggttcaagggattctcctgcttcagccttccaagtagctgggattacaggcatgcactaccatgcccggctaattttgtattcttagtagagacggggtttcgccatgttggccaggctgctctcaaactcctgccctcaagtgatctgcctgcctcggcctcccaaagtgctgggattacaggcgtgagcccccggcccacatgtaaaagtttatatctctgttgtttcaccttgtttttgacctagtctttcagtgatttgaatcttgattcagtcttttgttattttagtggtacttcccagctttgtgtcatctgtggatgacatatgagtcttgcttcttcatgccaatttaagaagactgaacgggaataggtcaaaggcatggccatgagcgatttctctccagcttttcatggtgttcagcttcaaatctattcacatattggacctgcaagccatcatcttatccacaggctatcatcataggtgaatgtaaattgggtttaggtggccaagctgaacgtgagatatnttcagcatgttctctaaaggcctatcaaagctgacatcaaagggataagttccagttacccagctgaagggaaggagggtgtttcagatagaggaaggataagcatgacctattcaaggccagtgaaagaagcgtgcaacggccaagtcaggagaacctgaaattgtgtcaaagagcttggatgcaaagagccgtgggagactattgggggttttaagcagggatataatattcattcaagcatgcagtaaaaggtcactggcacctgccatgggccaggactcgggctctacatgattgcgtctgttttggaaatatcaccctggctgtgagatgaagaacaggtaggagggtcacaaaacttgaagcagagagactgttgaggaagtaagctgtttttgtgtggactgtggcaatcacagaggcagaggatataaatgcacagagacacaaggcatgtgggaggcagaaggaatcaaatacaatgagtgatcagatgtggggttagaatggtgagtganaaagacatactcaaggtgacacgcccaggtatctgggtggatggtaagacattcatggactagaatcgaagaggaggtggggatggacattccttccgtttagaggggttcaccaggaggatttgccggaacatggagaggattaaccaggaatccggtgcctttttccaaactgggttggaggggggtgaatgctttggcacgctgtgtagattttaggtgacgggtggtgacaatgagtccgtgtcgagcgctgattttttcggcctttagagcgagatttatacaatagaatttggcatgagattggattgcttttagtcagcctcttatagcctaaagtctttgagtgactagatgacatatcatgtaagttgctgataggtttccagttttccgctcctaggtctgcatattgtacttttcctcttactcgacttaaccagtaccaacccagcttctcaacggatttataccatggcactttaaagccagcatcactgacaatgagcggtgtggtgttactcggtagaatgctcgcaaggtcggctaaaattggtcatgagctttctttgaacattgctctgaaaacgggaacgctttctcataaagagtaacagaacgaccgtgtagtgcgaatgaagctcgccataccataagtcgtttttgctcccgaatatcagaccagtcaacaagtgtcaatgggctcgtattgcccgaacagattaagctagcatgccaacgggataaacgagtcgctcttggtggagggggggtggggcgcctggtgtttctaaagaggatctcctgccagaaatggtgtgctgacactgttgtcctccttggtgtggaactttggtgggaagaaaggttggaaagggaaattttgatccttggatttaacccgagtttgttactgatgctcacaagactaggggaaggataaaggcaggtgagtcactctaggatggctcantgagctccacagagctggaaccacaggcaccaggagggattcagagcaggcctcagtgcacgtcagctgagtgaaccaatgagcaggtgatgggtccaggcagagccctgtcctctttaggcaaaaacccttgaaacaccgttcccatcctagcctgtgttccacccaaagctggccagtctccaggccctgcctgagccccaaggaagtggtatggtgaaacagaagggccattcctgtccaatgtgtgaggaacttcatttcagacttgttggaagccctgatgttcaaaaacctcaatgatatcattcattttccccatccattcaatgcccatccaatgcccatccgttcaatgccccttccattcctcttcagggaaatgaaaattgttcagaaatcctttctctttcgagaaaccaaccaaaccaaaaccgcgaaattcactaaactagccaagacacaatcctgggttattttccttttcccaaacctcctctgtttaaattaattctaccctggttctcggcccttactgcgaaggtgaactcacctaacctctcccaaacagagaagaaacttctcttggtaaaatgggttttaacacttctaaaaaacccccgctatggttctaaaggtaatggactatggcgtacacaacgtctcgctcatcgtctgccaggaggctaaggtatccacggacaatcgctgagcaacagtgtcgttgatccatctctgtacgcacttgtcaacatggcaggagtacgggagctgcgagaatcctctctgctgatgtcccacggagcatgccgtgagacaacgccacgaacggccctcggagananctactctgcaatgaagacgtacgatacacacgtaggagtcctagctcaccagccgtatctaggtatactgtactcgcggatactcactcgtgcatgcggcaatagatcgatacgcagtcgtcacgcccatgctctcagtgtgtgaccttctggcggtagcgtngtgggcgctattactgtgcgcagcaggcgcntcgtacatgtgtcgggtagcgatgccaggagctgtaacatagcaagtcgcccccctactcctatcactatccctacgctggaccgcactcgagatctgaacgcacgtcttaacctgccagtactcgtgagacctatactgcgcaagccttggctaggagatcctgcagcgccggcaaagaatcagctatgatccccttgcgattatcgcacacgcaccatagagtatgtgcatattaacctctgaatgtgctgcaagcagacggttgctcaacatatatatggatgtggggaaatcgccctggtcaccgccacttggcgtcaggaggcaccagcacgtctgagtgtcacgcacgttactcggccgaatggtgaattcatccgtcgtctcgagggggtgaaagacggggagttatgctgtaatggcaccgctcaccctgggcttatgagcagacctaaccctcccanagtgctgggattacaggcatgagccaccgtgcccggcccagtatctgaacttctgtggccaggcagaaaaggtcctgtgttactcgtctcctttatcattcatgtccatattctcccatttgctaacatttatgtttctgctccactggattctttggatttttctagaacatacccatgctttgcattgccttggtctttgaatatttggtccacttttcctgcaaagtcccctctcaccttatcttcctggtaaacttccagccaacacctctttactaaccagagaaacatggttcaactgtgcacaggcttgcacagaaactgttctcatattgtcttgtcattgtcaatgtggcagagatgcaccttagatacctctttgagaaaggactcactgcccagctgcctggcacgtgatgagctgatagctccagctatagactcctttagggtcaacctctgctttccagttgagatcatatcctttgcagggtggcctccccagtgatgactaaggcagtgttacaatggcctagtcatttcctcccaatgctggactcccaatgaaccatctgctccggagcttcccactgggcagtcagagaccttagctagtctgcctccgaatcagaaggctctctcttgccactctggccgctgtgtctaaagattcacggctgtagttccaactcccgccgccctctactgtgtcctcttaatggcagtcattcaccatcttcctgtccctccccttcatttcttggatggtgactgtcactttgctgcaacagaaccctgtcccaatccttgatggttcaatacacacatagacattctttttaacagggcggcctctcaggtctttaattttcttccctccaataaccttgtgatgatcccccagcttagccacttactgccagatcattaccagtaactccagcccctccttaattctagtttctaatatcctaatctgtgacctcacattccaacttcttcattcttatcccctgagtcaaaaaatcctttgatccatgcaatccattaagtcatctaccttttcaccattcttcgccccactagggttctcattcctttattacccatatgaaattccaaggcctgttggaatcactcccttgcagccactgtcaatacttctgccccttttacttcatcacccttatgtggcaaaaccacagccctggtggagtcgatccttacccctgctctgtgccaacagccgcacacgcatggctgatggaggttggaaaaatccacacatgcagtgggccctgtatgtccatatacgtatccaacctccagccttgcatatgcctcagtgctgcctgacaacacattatatgttttccttagttccttcagtctcctgggtgcctaggtgagtatctcagacatccttctctctctgcaaagctccaacacctccacgtcacattcaactgatgactgtgtctcctatgtcacttagatcacagaggcatacataaacaaatcccagccactgccagcactctgcacatctgcgagcatggcacccccaatctaggcctttcctgctgtcacttggggtgagctgattatactcgatcctagtcatttctacttatgcaccttaaggcctccctctaacattttaatttaagattgaaaaagcaaagattattctgttttggctgcgcctatagtaaagtaacccctatgncaaattttgacaccttatagtatttgacagggataagtataaaattgcttgattgatacatccacacccaaatgtatgctgggaatgattttgtttcacggcactcattacttaatttttaaaactcttatttaaatttgcaatgttttaaatgaccatcacttaaagtagtaatcaacagaggttaggagaacataacaatactctttctcttagaaaatacaacagaaatataattttttacagttttgctcccaaacttttctctgtaataacatgccttactcacctttacaataggtttgttgtgagaatcttgtaatgtaaaccctgggtgttctgtgaagcatttttaaacttctagtttacactgactcttattcaagtgtttttaaaaatatatttaaaaaactggccaggtgcagtggctcacacctgtaatcccagcactttgggaggccaaggcgggcagatcacaaggtcaggagtttgagaccagcctagccaacatagtaaaacctcgtctctactaaaaatacaaaaattagctgggcgtggtggcgggcgcctgtagtcccagctactcaggaggctgaggcagaagaatcgcttgaacccgggaggcagaggttgtggtgaaccaagtttgcgccaatgcactgccagcctctgcagngacagccgggggcgggccgagtgatcctaaagcccgctcgcttcacaacaaagcctaacagtccaatcacttaatgctgcatttattcctggggaagcaagtctcctttgcactttacacagtgagataatcagtttctcatgtggaccactgggccaggagggcctgacaaagggcagtctacatttcagactggaaactgctcccagaactatttctttctagttcccacctcggtctgaggtgcctgaggagagggactcaacagaggaagcaggagcatagctcaaagtctcagaacatggaagaggaaaagaatcctcacaagattacgtaacttacaggcgtgttgctgcttcagtagaagtttcatctccctcaatcctgtacacttttccatacattacatactcaaactggtcagccctatggagcaatagcagcaaagttattcttaacagtaattaacaatataaaagatcccatttaaaaatggttactggtcagccgggcgtggtnnntcnancctntaaccccancactttggaaagcatgcgggcgatcccaagtctgatatcgaaacatctgcctaacatgtgcaacccctctctacaaaatacaaaaaatatccgggcttgtgttggcgccgttatctcactacccggagctaagtaagaaatgctttacctggaagcgatttttttacttatatcccctctcttcaccgggcgcgaccaaattctttagtataggaaagtttattgttttatgcctttgtcaaggctctactgtatcttttctgtccactcacggttctgaacaacagcaggcgattcctagccctgtacccggggcattgtccaacactcgacagggctgaattcgtccataacggtgtgcccctctgggatataggatgaaatgaattgatctgagtacctgggatgtaaagttactaaaacgccagctaggttcacgccccgatgcttaaatatgatcgtggcctacacctcgtccagcagaaaaagtaccctttcttcaacaccacctcacgatcctccaatttaggagctataaaactcatgactctttatttaccccctgcagattctcaatccaatagtgtgtgtctccctgtgaactcacggatataccgattttccccacgtcatttccacacgtcgcaatcgcttagtcatccctatgtatgagaatcatggatgactatgttgaagtccatctataaagttcaacccccatctccgtccctgattccccctccccaagatcaccaacgcgactcgacatattgttatcgcccaagggacctcttgcatcccccatatccactggtcacctcccctcttggctggaagtcaccgggaagttctccacatgttgttgcgagcgatgttcctaaactttagcgccattgactcgagcatggtcatggctgtttcctgagggtgttcctaaaggatactacgttccctaaagtccagagaaaaaaaaaaaagtaacataatgtggcttatttggtataaaaattttacaggaagcattgtcaaatatgaaatagtgtttggttttgtttgggctgtatttgtataaatatgttattggtatgtgttccaaaattataggaaactcctataattctgatatgacttggtgtacattatcagtaataattataattgttatggtaaattattgtgtgccatggaggtaacaaatttcctcatcaagtgtgtctttgactatggttgccctaaaactttttgccattcacagacaattgtcttgctttggtcctctttagaaggtggttttataatcagctataaaactctaacgggtgctcttgaatgcaggcttaagatagctttggagactgtgacatcagaatagaggaaaaactttcagtattcatggagtgctgaaatattcatgaatatcaagcaaaacaggaattaacttcatagatggaactaaaagaatgctgaagtaatctttttgactttttttcttaaaatgttgatccttcgttttgtttttcagagtcaaggaaatttttctgttgagatattgacagcttttaacaattaagtatactccagtgaacacaatttggagcatatttgtgtctctctatatatatttggaaacaatntttgagtattcttaacttattgcaatattggttgtctgctataccagtaatgggattgctgggtcaaatggtatttctggttccagatccttgaggaattgccacactgtcttccacaatggttgaactaactgacactcccaccaacagtgtaaaagcattcctatttctccacatcctctccagcatctgttgtttcctgactttttaataatcgccattctaactggcatgagatggtatctcattgtggtttcaatttgcatttctctaatgaccagtgatgatgagctttttttcatgtttgttggccacataaatgtcttcttctgagatgtgtctgttcatatcttttgcccactttttgatgggtttttttttcttgcaaatttgtttaaattccttgtagattctggatattagccctttgtcagatggatagattgaaaaaattttctcctattctgtaggttgcctgttcactctgacaatagtttcttttgctgtgcagaagcttttcagtttaattagatcccatttgtcaattggcttttgttgcaattgcttttggtgttctaatcatgaagtctttgctcatgcctatgtcctgaatggtattgcctaggttttcttctatggtttttatggttttaggtcttatgtttaaatccttcttttttttttttttttttttttgagatggagtcttagtctgttgcccaggctggagagcgagtggcgtgtctntaggacgcgcatgttgtctaaaggtttgtcttcctccaaaattcatatgttaaaacctagccccaaatgtgataatatttggaggaaggctctttgggaggcagagccctcatgaatgggattagtagccttataaaagagacccctgagggctcccttgtcccctccaccgtgtaaggatgcaacaagaaagtatggtctatgatccaaaaagcagacccttgccaggtacccaatatgctggcacttgaacttcccagcctccagaactgtgagaaataaatttctatttttcataagccaccgagtctatggtattttgttataggagcacaaacagactgatgtgccacccaaccatgattatacgtgtaatttatggtttctctgctagtagggatgcaccatggggttaggaaccacgcttttcttatttcccacacagtccttagctctaagcatgttcctgaatcaaagatccccatcttttatgaatgaaggagtcagtgaatgaattaatgaaagaactgataaccctcaataattattccagccttttatacctactattaaacggttctctaaagactttcaagagctggattttatgctttaggtgaaggtgataaagtaaagtgctttcactgtggaggggggctaactgattggaagcccagcgaagacccttgggaacaacatgataaatggcatccagggtgtaaatatctgttagaacagaagacacgaaaatatataaacaatattcatttatcccattcacttgaggagtgtctggtaagaactgctgaaaaaacgccatcactaactagaaaaattgataccatcttccataatcctatggtacaagaagctatatgaatggggttcagtttcaaagacattaagaaaataatggaggaaaaaattcagacatctgggagcaactgtaaatcacttgaggttctgattgcagatccagtgaaggctcagaaagacagtacacaagacgaatcaagtcagacttcattgcagaaagagattagtactgaagagcagctaagacacctgcaagaggagaagctttgcaaaatctgtatggatagaaatattgctgtcgtttttattccttgtggacatccagtcactcgtaaacaatgtgctgaagtggttgacaaatgtctcaagtggtacgcagtcattactttcaagcaaaaaaattttatgtcttaatctaacgctatagtaggcatattatgttcgtattatcctgattgaatgtgtgatgtgaactgactttaagtaatcaggattgaattccattagcatttggtaccaagtaggaaaaaaaaatgtaaagccagtgcttagacacagccgctgtcttaagaactgggctaggagtgagcagtgagccaagatcgcaccattgcacttcagcctgggcaacaagagcaaaactccatctcaaaaaaatacatatatatatatgacccataaaaaggagataaatcaacacttcagaactgacccaaacttgcaaagatactataattaacagaaaaggacagtttactaagtactccgtatgttcaacaagtgaaagattaaacatattaagtagagatgtagaagatataagaagatccaaaatgaacttttagagttgaaaactacaatatttaagataaaaatacactaggtgggattaaaagtagattacacattgcataagataaaaaaaaatgagcctgaatacagcacagtataaactatcttaaacaaaaacacagagagaaaaaataactttagagacttagctcttatcctctatttgtttctaaacagaggataaggggcagaaaaaatgtttgaagaaatcatgatttttaaatttccaactgagataggaatagcactgggtagtcacaggaggctggaaagacccaaacagcagttaaaacaggaactaggcaaagaaaccaaaggataacagtaaacctaaactaagggagagaaaactgacaaaagctgacttaggataactgaccctgaatataagccgcaagtaaccaattaaatttgttttccaaaattgtattaacaatctatgaaatttttatcttgaccatagctataacttccagaagccttttataacctctataacctttattaaggagtaggttaatgcttcaagaaaaccttgttaatctgacacaggacccatatgctgatcttgcatcagtgtggcttggacatcaatgattatgattaatttatagagaaattgaacttattttatctctcaaaattggcccttacaatctcacacacccacctcttccactatagttcctgggccttgagttgaatagctttaatttctggctctgtgtttcaagaatgcagtttattttgattggcattttctaccagtcctgaagatgaacctttaattgctgtcagtatttaagatttagcaggacttgtccttttaagaaccaggagtcaagccctataactcaatgtcacaaggactttaaaagcacatacataaagatatatggatgtaataatcataatttttaaaaaattgtattaatctcagtgttttctaagcaaaccaaaacttaataataatggcatagaaattatttcaataaaacataaaatctgttaagccagttaccaaaaggcaaaagaaaagaccttctgcaatgcacagaatattatgttggaagaaaacatttcctttagacctttaagaaaacattgttagcatcaggacacaacaaacagaatctgagggtaaaaaacgtatatgagctgaagggagttgaaggagggcattactatttcccacccttttaaaggggagagaaaacctaaaacagcaagatgcaataaaagctgaactttgggttaaaaaaaaattcttaagtctcttataatttattaagagtgaatcaaccccgtaagaaaatttcattgttctaaccaattttttaatatataagtagttttttaacatcaacccaatctctagaaagaccattataatttccctttaattatagacaactttatcatataaaagtttttttaaataaatcctcttattgtgacttacacagactattcatgacatgcttggactttctggtttgtcgtgaacatccttttctttctttctttcttttttaaattttactttacgttctgggatacatgtgaagaacatggaggtttattacgtaggtgtacatgtgccatggtggtttgctgcacccattaacccgtcatctatattaggtatttttcctaatgttatccctccccttgccccccacctcctgacaggccctggtgtgggacatcccctccctgtgtccatgtgttctcaatgttcactcccacttatgattgagaactgcagtgtttggttttctgttcgctaaatataagctatgataaaacagttggccctctgtatcatgggtttcacaactgtggattcaactaactgtggatgaaaaatacttgggaaaaaaagaatggctgcatctgtactgcacaagtgcgtgcttttattctcgtcattattccctaagcaatacaatataacaactatttatatagcatttacgctgtattaggtattataagtaatctagagatgatttgaagtatacaggaggatgtgcttaggttacatgcaaatattatgccactttatataaggcccttgagcctcctcagattttggtatccatggcagtcctggagtcaattctcctgcaacatctccatttgttcagattctcttctatatcatgtttatatcagaaaatctacataagattttttaatgtgttcatataggttttgtgtatttttggttgttaatccctagatatatgcagtatttattgctattatgagtagtgtttctttaccatgtattctagttggttattgctgacagagaaatgttgctggtgtttctaagttaccttgtttctaacaaccttgctgaactcttattagttctcatagtttttaattaatctttcttagttctgataacataatctgcaaataatgacaattttatatctttctttccaatgcttatatctctcagtcctctttatcccaaagtattttccaggatctccactataacattaaatagtaataagaatttctgtcttgttactgatcttaaggagaataaatttaaatttcctctgtcaggttttatgcttgatatagatttgtgatatatagcctttcacaggttaaaaaaaaatgctttcctagtagtcctaattttttaaaaaaatcatcataaatagatgttgaacattatcaaatgctttttctgcatctatagagataatcatatggttttttactatttattaatgtaatgaattagaccaattttctaatgccaactctttcttgtatttgtagggtaaatcctatgggatcataaaatacttttaatacattgttagatttgaagagttaacgccttatttagaacgttttcagtcacatccataagtgaaatggcactatagtgtctattactattatatttttctggttctgaaaccaaaattatactcacctcatacagtaagttgggcaacttttgttctttttttctgaaacaatttgtgtatagaagaaattaactgttccttgaaagtttgataataatcatccagaaaattatccccatctagggcttttacaaaaaggagactctagaatgccatttcggtttccttgatgtgtattggcctctttcatttaggcttttggattttttagggcattttttcactataggctttttaccggcataaacttcaggttggatgttcggtcaaagtggtccggcgatgcgaaaacgagagggctcgaggactgggcagagaactatttgaaggtatctctcaggggaaaccaagcggaaggcggggagtaaaattgggagggagcgacggccttcaaagaaggggcttgcattagatcggcgagatccgggagggtctggtggggagaaatgactagaggacaaatctaatggagagacagacggagatagatatcgtgacagagagagggacagtgacagcgcacaacagtgcagggtccatgagtacaaggcccttaagtgtacaccccagccggagtcatggcaattcgattcctgtactgaccacccaggatttgggtagactgtacgagttaatgagcatggtccccaacaagactgcttcgacctcagatgcaaagcacacttcaggggtccccaagccactcatgttttttgaatgactgccataagttcaaaaattcccacaattctctcagattcaataactgggtataaccactcatagaactcaagaaaatgctatcattattattacaattttattataaaggatacaaatcagaaggactagccaaatgaggagacacatagagagaggactagtaaaaaacagagcttctgcgtcctaccttcaaggaatcaggatgcaccaccctcccagcacatcaagtgctcatcaaccaggaagttcctctgagctccaatgtccagagattttagggaggattcattacataggtatcattgattaaatcattggccatgtacttgaactcaatctccagtgtccctcttctccctagaggtctgaagggttggctaatatcatgtggctcaaagccccaactctaattacctttttggtcttttcagggactagaccccatcctgaagctatctacaggccctgccatgagttagctcattaacataacaaagacacttatattactcagaaaattccaacagttttagaagctccatgtcaggaacctgggacatagatcaaattctttttttttttttttttttggagacagggtcttgctgtgttgcccaggctagagtgcaacgacagatcacagctcaatgcagcttcaacttcccaggcttaagtgacctttccaccttaaccttccaagtatctgggaccacagaaaatggctaattatcctggctgatttttaaactttttttttttgtagggatgggatcgccctgtgttgccaaggttggtctcaaactcctgggttcaagcaatcattctgccctggcctctgtgatggttaatactgagtgtcaacttgattggattgaaggatacaaaataatatttttgggtgtgtctgtgaaggtttcgccaaaagacattactttgagtcagtggacggggaaatccccccttccccatgggacggggagacccccctccatccaggtaaaaaaatctaatcacctgcaatgtggcagaaataaaggagggaaaaaacggggacccctanatgggttattctccacctaattcttcccccaggccatgtatttcatttctacagaccctgagatgaatttgtcattgccacggggtcctgaagttcaaatactctatttggtatcctgcccctgtggttaactgtgatcatttcactcaccttgtttatgatgagaggtgccaccatctggcctcctccactctgcaatcctgttaattcctatcaaagctgaaaacctgctgcagcacccacaccatcacctccagcctagagagggaagctaccagtgagctctcctggatgccggtgtgcccctcgccaatacatttcttcttagtcccttggtcatcctgaggtgtgtgattaatggacagctatgtggattgcacataatagatgtactccagcatcttcatccctgattttcctttacagaaatcactcaaccttagcaacatgtgaaaatcacctaaggacattctttaaatccctctgtccacatggcaacacaaaccacttaaataagaatctccagggagtcactcaagcatcaatgttttttaaagctccaattttaaggatcattacattatgtcgaagaaattatagtatttcagccttactgactgtaaaccaccaccatatctaagcatccattagtcaacctagcagacaataaactaacattacctccaggtactcaaatcaattcattgcatcccaaatcccagatgggcccacccttattgacaaattcagcccaatcttggttgaacacatttagaatatatttccatgaacaatatccggttgacgagtttctttaactttttggagtttaagccatttcctttcacagtagccttgttaattccctgtcaatgctccatgggggtcatgaagagacctcttattaactgtgaagcaacttggctcaggtgcagacactcaaatgcttcacatgcagtgggaaaagagagtgattgtctactttaaaaagaactgagtctttattcagtcgattcttctaatctatgaacatagcatctctctcaaagcatttagtccttctttaatttctgtcattaattttttaaaattttcatcctaaagattctgtatatgttttgttgaatttatgcttaagcatttcactttcttggtaacaattataaatgattttgtgttttttattccactagttcattttcagtgtgtagaaaagcaatgaatttttgtgtgttgatctttgttccaacatcttgcaacattattgaactcatttattagttctaggaggttttttcatttttcttgtagataccttgagattttctatatagacagtcatgttgtctgcaaacaggcacagttttatttcttccttttcaatctatatgcctttttttttttttttgccttattgcagtggctagaacttctagcactatgtcaaatagcattggtgaaagcagacatccttgttccttgtcttagaggaacatttggtctttaatcttgatttaaaaaattccttgcactaagttaccgtgttttgcgggagggagaggtggggtgaggtggggatttcccctaatgtttacaagctgggattttctttttcctgtgtctaattattttcctcattggcttgaaaaatctgataaaacattttaggactgtgtataaaatagaattagccaagtgcaatgtctttattcagaagaaatttcatggacgttgtgcctactctcttggcttcctggcttcatggctttccagatcccacagtaagctctggatagtagaagttatagtaagactgacttctaaataaatgaagtgactttaaccttactgatatggcttaaagaaaaggagtggcctttaagatccatgaacttctcaaacaaaagtgataacgttatctccatgcatatataatactaaatataatgcaactgagagaagtaggctgtggtaagaaaggagacccaagtgccatctgaaggcagcacttaccactctgcttcatcccaccgaggaaacaaagcatgagtattgccagattttcttctgtttcaagaaaagccagaaatccaggtttttgcgtgaaatgtcctgattttaatgttgggaactaatttatattttgaaataacattgtgtgggacaagtgaacttgtatgtggaactgctttctcccagtggcgaccagtttggaccgttgatactcagcaagttcagccaagtgcgccttgtcattgtcagtcatcaaggtgatgtgtgattggtcaagcaattaattttgctcagcatctcgtgtgttttcaaaagaactgaaggttcatttgctttcagagcacaatgcgtattcatagtatattgacttaatttctaagtgtaagtgaattaatcatctgaattttttattttcagataggcttaacaaatagaacattctgtatataaatgtgtaaattagagttaatctttccaatcacataattcgttttatgtgaaaaaggaatgaactgttccatgctggtggaaagatagagattatttttagaggtttgtcgttgtgttttgggattctgttttcttttaaaattgtaaatatgtacttgtgtgaatgattttttaaaatgattttaccatttttggaagggtatttaatgatagaatatcatcgagccaacatgcactgacatagaaagatgtcaaagatatattaagtgtaaaatgcaagagggaaaacactatgtacagtctgagccaaatcaaagcatgtatgttttttatatgtgtacaacaaaaggtttggaaagatatgcgccgaattgttaaatgtggtttcacttgagggggtgggaggatggggccccagaggggtttttatgggggcctttcacttggtatttttttcattttgttctgtttgaaattttgttttttctttttaaatggagtttcactcttgtcgcctaggctgcaatgtagtggcgtgaactcagctcactgcaacctccgcctcccaggttcaagtgattctcctgcctcagcctcccatgcctcctgtgtagctgggattacaggcacccatcaccatgcctggctaatttttgtattttcagtagagatggggtttcaccatgttggccaggctggtctgtaattcctgacctcaagtgatccacccaccttggcctcccaaagtgctgggatttcaggtgtgagccaccacgcccagccctgtttaaattttttataagtatgtactacttttgtaatcagaattattagaaagcattttactgatttaaaagcttagacatgttcaaatgcctgcaaaactacttaacactcagctttagtttttctaatccaaaaaggccgggcagttaatctttttggtgccaatgtgaaatttaaacggttttatgtttttcctgtgttgtgaatgaaaaatatttctgagtggtggttttttgacaggtagaccatgtcttgtcttgtttcaaaataagtatttctgattttgtaaaatgaaatatacaatatgtcacagatcttccaattaagtagtaagggtttatccttaatccttgctaatttaagcttgcataagtcactttactaaaagatctttgttaagctagtattttaaacatctgtcagcttatgtaggtaaaagtagaagcatgtttgtacactgttgtagttatagtgacagctttccatgttgaggttctcatatcaccttgtatcttgaagtttcatgtgagtttttaccattaggatgattaagatgtatataggacaaaatattaagtctttcctttacctaagtttgctttcttgactagtaatagtagtagatatttctgtaataaatgttctctcaagatccttaaaatctcttggaaattataaaattattggaaagacaagaacagtttttattcattatatgcattattatcgctttctcaagaaaagggaactggagcaattaaacatatgtaatttttttttaaaaaaccctaaacctaaacatctacctatatacaaaaattaattaacaatggatcatggactccaatgtaaaacatgaaactctaaacttctagaaaaaaaactggagaaaacctttggtacctatgacaaggcacagtttttagacttaacactagaagtgtgaactatacaagaaaaaattaataatttgaaccttatgaaaatcaaattatttgctctccaaaagaccctgttaagaggatgaaaactaaattacagattgagagaaaatatttgtaaatcacatatttgacaatggacttgtatctaaaatatctaaagaactctcaaaactcaacattaaaaaaaatatctaattagaaaatgagtgaacattttacgaaaggggccttatagattagcaaataaaacacttgaaaagatactcagcatcactagccattagaaaaatgcatattaaaaccacaataatgtatcgctacacacatataagaatggtttatgaaaaaatagtgatgacaccaactgttagtgaagatgtggagaaacactcatacattgctggtagaaatgtaaaatggcatagccactgtggaaaattatttggcagttccttttaaaactaaaaatcaatctaccacacaacccagcaatttcattacagggcatatatcccagagaaatgaagatttatgatcacacaaaaatctgtacacaaatgttttatggtcactttattcataatagccaaaacctggaaactatccaaatgtccttcaatgggcaaaggattaaacacactgtgatacatccataccatggaatactactcagcaataataaggaaagaattactgctacacacaagttggattaaactcaaggaaattgtgctgagtgaaaaattaacaagccaatctcaaaggacacatacttcatgattccatttgtataacattaattaacacaattaattacagagatggagaacagaatagtggttgccagggattatacatggtggacgcggtgaggcgggcctccacgccttggagatgaagggggctacaccctttaaagcacacccacgagagagttttgtgcggaggggcccaatttaagtactccgccccggggggggaacacaggggcaaacaaaaaaaattggccttgggggtgaccaaacacacaaaaaaaaaacaaacacacaaaaaaacaacnatgggtgggaggattaatcgccaaatctgagtaagctatctggacagtaccaatatcgatttcccagttttgatgttgtactataataatgcaagatgttaacattggaagaagctggctgaagggggctcaggaactctctggacatttctttgtaccttcctgtgaatccatcattattacaaaataggacattttctaaaggttaaatcattttaattttaaaatgtccctgttactgttgaaactcacatctccatatactgatcaagaacagcactaatggcccctggcctccaggaattcacaattcctactgacttttctttgaaaccttggccaagtcgcttctcttctctggtcctcaatttttcatcttcaaaatgaagattgaatgactattaaaatctcttgcaattcttgagatgaagggtcctaaaggaactgaagaggatgccatgtaatgtaaatatgggtttttactccatcagccagccaagacagagggcagacaccaagacatggtaaccaaggaggccatgtgtaaacaaagaccatttagacttatgctctggcctttgcagcccaactggtgtggccagttggtggggtatgaagaaaatggggccttccaggaaccatgttgagtggagataagcagggaggaatgcagaagacatgggggcagtgccagtctcagcccgagccagctacacccacacatggttatgaaagactgacagcctgtaagntgaacacagccctgcctctcttagataggcgcaaatatgatctcagatgtggatttactgtaaagttcatcaaatttaaatttcagaacacttaatctgcaagagtcctttccaagaccctatacctaattttgtgtttacaattttatatttgttttcttaaagaagaccaccaatataaactatatccagccttcatgataagtacataggaaactatgcaaataagggggaaaaaaaacaaagaaaaatacctagtttactaatggttcacttctgaatagcacatattcataatgatacaagcactcattactagtctaggaaaatgaagatataattgcattaggaagatcaagaggtaggaaatgtggatgtgtgtggtatagactagggcaggacaaagaacctaaatcctcattttctaaagataattgttaatacgtaaaactcaaaattcaagaagtaacagtaaaagcggtcattaagaaacaagcactaaacaccagataggaagcgagagatgggggaagagggcgacaatctgattattttttgcaacaaattttgtaaaaccatttgactgtttacatgtagaacttggatcttttttaaaaaacacaaaataataatactattattttttaactggatttttgaaaaagaagataaaagtctcattttagtaattaaaactcattccaggttagtccactcaaaacttatattcgaaaattaaaactttgggaggctgaggcaggcagatcacctgaggttgggagttcgagaccagcctgaccaacacggagaaaccccgtctctactaaaaatacaaaattagctgggcgttgtgcatgcctgtaatcccagctactcgggaggctgaggcaggagaattgcttgaacccgggaggcagaggttgcagtgagccgagatcacaccattgcactccagcctgggcaacaagagtgaaactccatctcaaaaaaaaaaaaaaaaaaaaattaaaacctctggaagttgagtttgcaaatattcattatgctcatttttaacttgtatgtttggaaaatgtcatgatgaaaattgaggttgggggatgagaaaaaaagaaaaacatcaaccccacagcccattcaattttcagcccgacccacagctccggggaagggcagcaggtccatccttcactctttcttcacctctttcccctccttctggctcttccacctctaatttggagcccaaaaaaaggcactgggaaatggaaaagtcttttgtacgtggtacttgccggggaagctgccatgaaaacctggccccacggtggggagggaatgcccanctgaggcctcgtgcccatgctaggatagactcgtccaaacatgtcaggtggtctgacagggcaagcancangaaatcatgtatgagtatgaactgatctgtatgcaagggcggggagaacacgcggaggaatggggcgtgagaaaacagcacagtacgtttctttagcagctgtctctgctcagccatgggaggtcacagagaaagaggcttggaggcgttattttcactgtgagatgtgagtgtaaaaaagtgcccaagacacagtgagtaccagggagatgccctctttcctacccgaatgcagaatggccacaggccttaaaacacacacatgggtcctcagaggagagaggcctccacagtggacacccgcattctcccctggtcagcagcagcagggcgagtgctgggccatcatgaagcttcacaggcaatgagctctcagcaataacaggaacagtgcctgggggactgtagctgcaagaccgattttcatgtaagatggcctctgaggactccgagatacaccaggctgagactagctggcagctccaagttgttggtcagaagagaacaggaactagggaaattggaattactgttactacaattcctttacatccgcacaaccatgaggtccagcgattttctattatttttttttttaagacagggtctcagtatgtcgcccagcatagagtgcattgatgtgatcatggttcagtacagtattcacgtcccaggctcaagtgaccctcctgcctcagcctctcaagtggctgggacagcagttgcatgctaccaggccaggctttttttttttttttttttagtttctgtagagcacatagcggttaacaatggcacagggaaacaaacagttccaggtgcaggggctctaaatctatcataagatgttaggtatgggggctctgccggacacaaactcaaggctttatgctgttatctcttgagcgaaatcctgggaacttcgtacattgcttgcttcagtaccttatcagttaatcggactctttgatatgttgggagtcagcgtacacaagttaactccttgaggaagggggtgggtaaggagtccttgatgtctggtaaatgaaggagcgaaatcgagttcctctggctttctcagctaagggagagcttattcatgtggaaacaaggctaagtgattaagggagaaagggagagtctgaaaacaaggttaggtattacaatgtcaataaaattggtctccttatacagtcctatggtagatttctttccatctttaatctccctctagcaccaccagactttttctctctgtaccttgagatgtaaattttgctatctgaattttcgtctaagagttgtttcctttaatatgcaaatttagggttatttagctgacaactgccaaagtagtgaaacaagttatcaagaacttgaacgtctaaggtaggaaaaaaaaaagtctttatgaatctataagatgtacttctattggcatgcctaatacgtctatgtatttacgtgttgtgtacacagtttttcactactgaaaatatatagaggagttctaattaattgacttaagacaataaaagcgcttgaatcaaataccttatcaggaaaaaggaaaagacaagtcaaatgcttgttcaagtttatataacttaagtaaaatctttaataaataagctagctttaacattatttgaaatgtcttaagaattgccagcaggttctgggttacagaactagtgggggtgcagtggggtgagggttggtggggtggggggtggtacgggggctttgttttttcttgctgcccccttctgggttggggaagtggcaggaccttggcagcaccccgagccggcatggcgttaataatggagggatgccagacccaagtggctaaggcccggctgcagagccaagttggcatttccagactggggctcgggccgcaccctctccaggaccctccccttgtaccgagcagattgtcgcgggcagtttgggccagctgtcctggcgtggaatttcccaaattcaacaaatcctccaagaaatcaatccatccattcatccatccatccatccatccatccatccatccatccatccgtggcagattatgaagcatggatcattacttttgggatgtggatatattcagttaacaaggagcagctttcaagagctggattttatgctttgggtgaagtttagaaacactagctcccacacctcatgtgctctagcgcctcttacctcatgccctccactctcagtcttgcactcaccctgccacactcaagggcttccccaggttccttcttagattccaccgatagctcagggactttgcacatgctacggtctctgcctggctcctccccagatcttctcatgcctagctgcttctcatcagcacccctcagagactgtccctgccccacctctccaggttccatacctgccaccctcccccaatcacgtaacagtttcttcacagagcgagttaccatcccagtatttccctaacttattttttgtgactggtctgttgcctgtctccaccacaagaacataagctgcatgtgaacaggagccttgtctatcttgtcaccccagtggctgtgacataacctgatacacattagatgctcaatgatgtttgatgaatgaagtgctggtagtccaactgtgtttccttgtctgtgtaagtatgtctgttgtggtttcctaagaacctacagctctcccactgtgactcctgttctatggtcctgatttgctggactagaatcctaacctacatgcttactcttagtgtcctcccccagaggctgaatcccagtccctaaacctccaccaaatggctaagacctagcttccaaccagacaggcctacgctgagacctcagcaccgcccttctgcggtctcatccttaacgcatccttcagggcccagcttaaatgtctcttctccaaggaaggctatcctctttctgcccctcagtgctctccatgcctcctctatgcctccatgcctgctttccaaccctgcagaggtggagaagttgctaatctgctgtgttgacatgtgctggggtgccttgggccagggagcaggctggtggtgtgctgatagcccgtggctgtgcccaggtccatgctcacttcctgagccccagtggagtaggctccctttcccttattgcagcactcagaggaaggacgtgcttcttaggacagatctggccaacctctccctcgtgagagaaggcccagccatcctcttgccctctttctttctcctgcccccgagtaataaaggtgcctggtcagagccttctagaaggagacccaaacatccaccacacattcccagttccaaccgtcatccacatggctggctgtgcaggtaaacgcagagtctgtttcacacacccaaccatctagtattggatgggaggacagtagcgtgacactcttctccagccttgagccctactgtgggccccacccaacccagataccagaggagccctgtactgggatgctattggatgcttgtccagtcatgtacaaagttagccctttgttatatagagttagctacgtacatcttcctctgtagggaacccaagaggggagaagagatatgtagtaggatttaacctgcaaatcctctgctgagcaccgtgcactacatacagtgggtagcatgtggtaggtgctcaataactattgaccgatctattgaatacacgtaagatcgtgacactatctaaaacgnggggtgtgggggaaaaaccccccccttgtttaggaaacccaaattggaccgtgttggcgcgcgattgtgctaaagatcatgcatgcctgatcaaacgtccccatatggcgtctcagagtcaactccttccccatcagtgccctgacttcggcataacaaacctggcaggttaagtgattaatcggtcctgtacaactgtagcccttagcaggaagcactaagcttcgttttcatttatttcttccctggaactgcaagaaatgagggatgccttccgccatgaagttttgctgattgtccactttgttctcaaggagatattcacagtttttaatttgtctttctctcctgcatggtctccaaacctgtccaaagaagccagctggctccatcatctgtaaaatcaccattgtcaccagagcacttgacttcctgttgccctacaatccacctgcactttatttcctgccaccatgataatgtagtgttactacattttacattcagctgtaagaaatgttacattcatttacttaaatcaaattaagtctgctcactcagtcccccacagtgaccaacttataaaagagaaggtacatttcagtcatcactgaggttctctctaccactggaaaactgaggaagggtctggagtccacagtggttaacatcattgcctctgttttttctcctactcaatgtaaccatccaaggttactcacaaattcacaaaaagaggtcttcacctctgctctcaagacccagagggctgggttctaaactcaaaggccaatgttccccaactttttgcattgtttcaacattggggaaaactcgaggggattcaagaatggttatataagttttgtggaaaaatgtataattttttaaaattaaaatacaaagtattatggaaagcactaaatattgaatttatataaatattccaaatatttttctaaatttttagtgagaaacttgagcttgcttctgtgagatatttattttaaaacagatttgacacttaaaatgtctaatcaagccttttaaaccatgatctatctcttcaaattcttcagatgccaccatcaataaagaaactttgttcacacaagtaagtggtagcaaatggcagggtgtttatcattttttttttttctttttttgagacggagtctcgctctgtcgcccaggctggagtgcagtggcgcgatctcagctcactgcaagttccacctgctgggttcacgcccttctcctgcctcagcctcccgagtagctgggactacaggcacctgccaccacgcccggctaattttttgtatttttagtagagacggggtttcaccgtgttagccaggatggtctcgatctcctgacctcgtgatccgcccgcctcggcctcccaaagtgctgggatgacaggcgtgagccaccgcgcccccgccgtgtttatcattttttgcctgatgaaattttccttgccactactctggatggtttgatacatttaaattgtgcttccagggtacaattatcctttaaatctatacctctttcctttcttttattgacaaatataatgttacacttttctgtcattgcagccacaccaccagtacacagatcccaacagagttgtaatattttattagtttcagagtttcaatattttatcactttcaatacttcatgtgcaggagttttatttggtacttctttacaaaataaatgatgtgcttccaagcatttcttttcaataattccaatcaatgttattaactgagtaatactagtatctgtttattcataaattcacaggaaatgcttttttacttattagtctttggaattctgttgtttgtataaacatctttcatgatggctttgtgtctaccaatagcactattgccaaaaggcacctttttcttgttcctttacttcactggtccgaagcctggtaccaacaactaccacacagactgggaaatgagcaattttgccacgtgcccttagctattaatggtggcactccataactagcatcttaagctcaatttcatgaaagaaatgtgtttcttattttgtacttgcaggcactttttaaacttgtaatcttttattcatactttaaaattaaaacagagtaatagaacccatagaaggaaatcaatacccacgagtccatactgatataaataaatagttacataaataaatggggggagaaataacagctcttccttacagaaaaatttcaattaataaatgaagaaggaattagggaaatacaacgttaccattaagcaaccacagtaataatcattacaggcaatatccaaaaataaattccaaagccagtgggcaaaagtttgaggagatacaggatattaacatagtctccaaatagctcatgctatttataaattacaaaaggaaacataacaactgtatagtgaagaaactcagcagacaccaccttagccaagtgatcaaggttaacgtcactagtaatagggcttgttgacatactggactccaatctgatacactgataaggacacatgacttctgcagtattcttaccaaaaacagaattctaatgtaattaaggaaaatgtcagacaaacctattctgagaaacattctataaaacaactaaccaatactttcaaaattgtcaaggtcataaagaccaggcgatggtcacagatttgaggagactaaggagatacaacaactaaatacacaaatggaaccatggcattcttgattggatcttgaaacagaaaaaggatattaggaagaaaagctgatgaaattctaatacattctgtagtttaattaatagtattgtaccaatattaatttcctagatttgatcattatactatggttaagtttttaacattagaggaatctgggagaatggtatatatgaactccactgttcattcaactttttcagtaactattatttcaaaataaagttgggagcggcggcccacgctgatctctaaagctttagaccacattggctcgagcatggtcatggccgtttcctggacgtcttagcgctatattataaagaaatattcacctccctgctgagcttacagggtgtacctaatgtccaacaatatgaaatctcttcaatgaattgcagcacgtccatatataacccacatggaagctgtcctctttcctcaccttcgaacttcccatgccaaagagggacctcttggactcaaatacatcttagcaatatagaagatgctggagacttgtaggagaagtggagagggtttacagtgtagccccacagaaaacaacttatgaccccatcagtcacttgtcccttttttccatgcctcagtctagtcaggaaaccactagatcctggatggcttcttctcccttcccctcctttctcttctcctctccctcccttgctcctccttcctccatcacccactccttacttccaaccaaaacttgactagctccagtctcatccctccttattgaaaactattttactcagccctcctcccccactcctgcccaatctttattccttacctacatcagacttcaccaaaacaaaggccaggataataaacaggacaaactctttcaaacacattttaatgaccatattttgttattttggtacaatttgaggagtcccaatccccagggaagactaacaagaagttctcctaacaaaggtgggtctccccttactaaaaactcctgtaatggctgaaaagagcatgaggttttctgcatatcattacacattcaatagaacgtcatgcagctgttaaaaatgatctgtagaaggctatcttgtgacagaaaggcattggagatatactgttagtgacaaaaataggttataaatgaatttttccatgcatgcctctatatttataaatacacacacataaaagacaggaaggacagacattaaacattcatagtgcttaagatgatgcatagtataatagttaggaccatggcctttgggacagaaaactacagcctctctcccacttatcagccatgggaccttgggcaatttgctcagcctcaaagcccctgttcctttatctgtgtgctggggttgttgtaagagttaagtgcaatacacagagagagagagagtacctaacatgtattatgtgctcagtcaatatgcatcatagtactcattgttacatatgttcctaagtgctttatacgttttttccctaagttgaccatctgtttttggcattatgaaacataatgatcctaacaaattaaaattaaaaacataaagaatatttgccccaaaaaaataaagaacatgaattcttcaagtagccaaggggccatagacagaagtaagcccttggtggggcttagttgagagaagtctccagaaggtctttcgtgtgttaaagaagagggtaacagggaggaggtggggagagatgttaactgagtctaaatgagcacctggaagaagagatgggacaggccacttctgcctggactccctgattgttaagaagaatgaaaaagagcagaagtcttccctgagcccaacttcactccctgacttaacctagtctttgccccttccctctcactcatggctactttctgtggtcaccttgttgtagaaatggatgtgcagccacctcatctttttctacctccttcacatgttttagataatttaatgtagtagaagacggttacagcaaaaaattacaaaaatcaaaatatctctgctatctactgttgcatttctaaccatcccaaaacagtagctgaaaacagcactcgtggtcgagcgcggtgactcatgcctttaattccagatactccggaggctgaggcaagagaatcacttgaacccggaaggtggaggttgcagtgactcaagatcatgccactgcactccagcctgggtgacacagtgagactccgtctcaaaaaaaaaaaaaaaaaaagcactcgtgtattttgttcaagatctgtggtttgggcagggcagggctcaatgaggacatctcgtctccgttcccgcagtgtcaggaagtgtaactgagactggagggtcacacagaagatggctccctcaagtggccagcaaattggtgcttacaattgacagggagctgttgaccaagggccccaattcctcttcctatggccccttctcgggctgcatgggcttctttacagaatggcagctggattccaagagcaagtatcacaacctacagaagagtggaggaatattgaaagttcacagtctcttaagacgttggcccagaaactggcaaaagcttcatttctgccatgttctattgatcagtcacagaacctgcaccaattcaagaggagaacatatagaggacatctctcaatgggataagtgtcaacaaatttgcatctatcacaatctgtcttttgggtacaaactatttctattcctccattatgcaaaatatactcacaacctcccaggggtcgcaaaagcctcatccatttatggcaaatgtggcccttttaatttatataaaataatttgcgggggcttcctttatatttttaactcccctgcgtgcagagaagtgatttaaagcccttcagaaagaatgctttattcccgtggaatttggtaacttgcttgggtgtggggaggtttgtcagctttctccactcaaattatcagaccctttccatttagtggtagaccatttccctcgtccaggccaagggcacatagtacagagaaatagggagttgttacccagggagagaacttggctctaaacctgtaatagaaaggtcagttctggtctggagggtcaattttgatctttggctcagatccaggaattggaaccaaggcttttgaacattttaatgcaggggattaaaaaaatgatacgagtcattcacgaatatatttgcttaacatctaaagagatccctcaaaacactagaaaaaataagaacaaaaatctaataaaacaaaatttgttaaacacatttaccaaatttttttttttggtaaaaattcaaatgtcataaataaagctaaagttcctcttgatgactcgctcctctgccctattccactccaagtaaccactattatcagtcttgccaatacccttccagacctctctacctctatataccattagaagcacatggttttgcattgaggatgtgcagtgttttgttttacgtaaatgttatcactctgttcttgttccataatttgcctttttctctcaatgatttgcttggctatctttctatttcagtagcatctcctttctttttaacttaccattgtttatttaaccttgcctctatcaacagatatgtaggttgtttctagttgatttcattaagtatttataaacaacgcatcagtagatgtccataaatttctttacggaagatggcaagtagtggaattgctgagccaaagaacatgtttaaaaaacccaaaaaaactagacgctaccaattttctctccaaaatggccatacccacttacccatacagagatgatttggaatctggcttcctcacaaggtgagatgccttcacagtttcattcttcctggcatgtcttcccttttgtatctgagagagctggcagaattgtgtcactaaatcaaggatagagggtcaaatgacagctcaagctcacaggcacctctgctttcttcccagaccacctgctttcctgccaccagctctgttccatcttatagaatggttgccacttgggtgtctgctccgacagccatgtcatcctttgcactgcagttatgaagcagacagagctaggagaggggctttgccagcctctgccctagcttggagaacttcaaaaaaggagggtattgaagttgaactcccccaaaaaggggtggtccccacacctcaaaaagtggtgcctccgaaagaaatgtaaaattcgtgtggggggggaaaaaggttatttagaaattgttggcttgtcgtgccgaaagtatgtgtggttacggggagtacggaaatttcgaggggtgggggcgaggccgtgtgtcctttagcccggggttttcccgtcgcatgtttaaggggggggaagaggggggatgttttctttccgcgaaggtttttgaagaacggcgtggccccccaccgccactactcaaccggccgttcacgaaacaactcgccacatccactaacccgctggctcaccacccaccgccctcccgatccccccaatccaaactcaacccccaccaccaagcgcctcccccctcccccaccctccagctcagccccaacctaccaccaaccccgactcgcccaccgaaaaccaacagcaaacccaaatgcccacaaaaccagtgtccaaaccctccttcccatcagtttggtgggcccatcaccgcttcccctggcccaggctctccttttgtgcgcttggagcagcagactgatctcccagccttcactcacttcatgtggtaatctgttgtgttcatcactgtcagaatcttctgcatcccctcactactctgctgaaaacactctagtggttcctcattgctcattaatgaaagtctagatattaaacgtagaaggcccagcacaatttgcccctatgccacctacctctctaatcttttctccttactctgacagactctccgtctgtcatttatgtattcttttattgctctcttctacttttagtatgaactggatttatggatttttttaacattgctttcaagtatggaataaagaattttatttatttatttatttatttatttgagactgggtctcactctgttgcccaggccagaatgcaatggtgcagtcatatctcactgtaacctcgaattcctaggctcaagccatcctcctgcctcagcctcctaagtagctatgactacgggtgtgcatcaccacatctggctaatggaataaaatattacaatgcctaatcttaattttcaaaattttaaattacattgtacctaatgcccatgcatttacttttttcagtgggtcaatagccctcactttggcaaaggtcccaggcccaaggtaaggccttactttttccaaactcatcttttgaaagacataagtgcctgtaagttgtaccacattaggttctaggaatttttcatcaaagactttatcagactattttcctctaagttgagaaagagctgggggcagaatatggcactgaatgactgaagagaaggcactgaaatcaggccagaggttgctggaaagagcaatgaggaacaccagcagcaatgaggagccggtgatgattttggcttcacagggaggtgtgtaccacaccgattttatctctacgtggatgaaccacagctgtcggctcccttgtctccaggacatcacactctccacattccctcccatcttccggcttctgcttcccggggccctcatctgccccatcctgggtgaacactggtcggtcaactgctgggcgtaccttcccgctctgcacaccctccctggccaccccacccactctcacggctcgcactgcagaggagccgcatctctagctccagcccatctgcctcttctgagctctaacttcatgtaggcgactcctgccggtgttgcctcacaggcccatcatacttcaaagcattttcccctcagaacaccatgtcctggctgctccctccagaagatacatctctcaagcacatccccgcggctctcacctggatgactgcattcaccttctcccacatttgccccctcctttggatgtatatagattgttttaaaatacaaatctgatgtgcttgctctcctgcttgaaacacctcaaaactgccttcaggataaaccactgcccttgacatgttcacaggttgcccatggcctggccctgcccatctcttcagcctcatctcatgccccttgcccctcgctctctgggcttctgcctccctagccctcctttaggttctctaacacaccatagtccttctagtgttggggcctctgcaagtgctgttcccattgcctgagacatgaatccctctccctatctctacctgcaccttcatctgattaatccctacccttcctactcatgatgttgctttctcagggactctctctgactttttaaactaatcagggtctccccagtatatatcttcatagcactctgtattactcctttcttaatgaccacctgctgtagacagaatgtttgtcttcctccaaaatcatatgtaaaaccttccaccagagcgatgattagagaagcctcccgactgacattcagaagatattaataagagcactaatgatggggattgcaaccatgtctttactgacttccagaagcttcttacagtaaacatgaaatcacataatttcttccactttcctactgtttcttgttctgggctctgtcctgcttactgtctaatatcttggccccttaaaagttgctaatcttccaaacctcattcctgtgactgggccgctggtccttgttcatgggccttgaagatactgactgtacacttatctggagcatccagtgcctaccacctgacccagattcctcattgcgctcctccctcctccacctaatgggatttgctcatacccgtgtgggacccctcccattttccccaactgaatacttatcaagacaacgcattgccatactccctcgtaccctgctctgggcatcagactgaatgtttgtttccattgaggatctgcagctgcatcagtttccccagcaccgtccaaccccttgagcatggctagtcctaaagcagagaattagcctttctatccctgctgctatacatgctgggacaaataataagaaatgacagcattttatgataatgcaggctgcaggaggcaggaggcaggaatcaaattcgtgcttatcaaatagtgctccaattctttgaatattggactatagaatatgtcatggatctatgctcaggtgggttccctattactcactccactgaggccaggttgtgggattagctgtccaagagggagtttcagtctcacagcatagggtcattctgagaattactggcccacacttgtgtggagacctccagagaacagaatctgggttggtgccatgtacttccaggaggagagaagtggcaggatgcccagccccacaatcagaggggaaggggcagagccacatgtatgaagatcctctccccagtacgtgccaatcacagggcttcctagcttttgggccaaggaaacaatgtgggaagcaaaaaaggacaattttctcctccctttgcatgaagactgagcagttttaccagattcccagggaaacacccttccactctgggttgaatgtgagtgagagacattcagctggaacactagaaaaactatttcctgagccactcacctttagccctagaaagtgttggatttgtccttcatctttgccacagtagagactgctgatagcatcagaacttgggctctggaattagacagatatgggtacaaatctgagctctctcacttattagtgtgggatgtagagcaacttttaaaatccttccaaacctcagacttctcatgcatgatgtgaggattgtaatagggcccacctaataggggtttttgagaattaaaaaagttattcaatgaacagcatttagcaagatgcctgaccattgagaaaataacaaattgtttattattattgttattattaaacatctttcctgcaccttctgactgggggcatcgtatcatcagaaatacttaggatgggatggattcctgcatgggctgagtcaagggtgcaataatggaggagtgaagaaggaagaaatggaggcagaaatccccaggagcccagcatggtacaaggctgagctagtgctgcagagcctccttggaacagccacagagcttgcatctggccctggaggaacctcttctagctggcaggaccagccacaacagtggccaggggatttcccagggcgtgggctcctcaggagttcatttggaccaagcctgcctggagaggggttataacagggatccttccctactggcaggtgatttacccctcggtgagaagctcaggcatttgtttgatggaaggtggaaggccctgtgctgggccagtgactatcagggatgggcgggtggctggaaaatagcaaataagacaatatgataacacagttaaccaccacactatgtgaagctacaatatgggtatctgtaatagacaattccaatgtagagaataattttaaggtgtcattctccccgccaatgccataagcacacggcctctgcctgggtttctcactgtggaatgtcctcctggtctcctcatgcccagagagtgggaagtactcctactttaacaccggctttcctgtcatttccntgcagccctcctcagccccctctgcacagggaggtttcctccctgctgctgcagtgctttgtacttgttagtggtacctgcacacaggtattggtgtccttgtctcaccaccctacatcactgtaagctccccaggagcaggcttcctgtttgactcacctgtgatcctccacctcccaccctgtagtgcctcaagcattctgtagagcacatggacgccgactaataagtacttcattatttgggtattttccaagaacaacatattgtaggaaaccattctttctaaaaaaaaaagtgtccttttaaaaaggtgaataatttttgtctaattcaaagtttattgaaaagttatgtataaaacaaggtaaaaggaacaaggaaataagggaaatgtaaagaaaattatagaaataaagtggtattttttggtaagaaagcttaaagagaaataattttaggtaagaaagaatcttacctaaaattttgtgctagaataaagtgactggctaagaaagggatgttcaaagctatttatgacaaacccacagccaatatcatactgaatgggcaaaagctggaaacattccctttgagaactggcacaagacaaggatgtcctctctcaccactcctattcaacatagtatcggaagttctggccagggcaatcaagcaagagaaagaaataaagggtattcaaataggaagagaggaagtcaaattttctccgtttgcagatgcatgattgcatatttagaaaaccccatcatttcagccccaaaactccttaagctgataagcaacttcagcaaagtctcaggatacaaaatcaatgtgcaaaaatcacaggcattcctatacaccaataatagactaacagagagccaaatcatgagtgaactcccattcacaattgctacaaagagaataaaatacctgggaatacaacttacaatggacatgaaagaccttttcagggtgaactgcaaaccactgctcaaggaaataagagaggaaacaaacaaatggaaaaacattccatgcttatggataggaagaatcaatatcgtgaaaatggccatactgcccaagtaatttatagattcaatgctatccccatcaagctaccattgactttcttcacagaattagaaaaaactaatagccaagacaatcctaagcaaaaagaacaaagctggaggcattgtgctacctgacttcaaactatactacaaggctgcagtaaccaaaacagcatggtactggtaccaaaacagatatatagaccaaaagaacagaacagaggcctcagatataacaccacacatctacaaccatctgatctttgacaaacctaacaaaaataagcaatggggaaaataattccctatttaataaatgatgttgggaaaactggttagccatatgctgaaaactgaaactggaccccttccttacaacttatacaaaaatcaactcaagatggattaaagatttaaacatggctgggcatggtggctcacgcctgtaatcccagcactttgggaggccgagatgggtggatcatgaggtcaggagatggagaccatcctgactaacacagtgaaaccctgtctctactaaaaaatacaaaaaattagctgggcatggtggtgggcgcctgtaatcccagctacttgggaagctaaggcaggagaatggtgtgaacccaggaagtggaggttgcagtgagccaagatcacgccactgcactctagcctgggcaacagagtgagactccatctcaataaataaataaatatggaactctcccaacacaataataagacaaacccccaaatgttttaaatgggcaaaaatatttgaacagacacttcacaaaagaggatatgtaaatggtcaaaaagcacatgaaaagatgttcaacaccattggtcatcagggcaaagaaaactagaaccacaatgagatgcctctgtacaccacttaaatgtccaaattaaagaaaacaagttttggcaaagttgtggagcaactgaaatgctcgtgtattgctggtagaaaaacaaaatggcataaccatcgcagataatttgttgtcagtttcttacaaagttaaacatatacttattgatatgacagttccattccaagagaaatgaaaacataagtccacacaaagacttgtacctgggtgttcatggtagctctattcataattgccaaaatctggaaacaaatcaaatgtccatcagcaatggaatggatatacaaattgtggtacacatgtacaatagaaaactactctgcaatggagagaaattaaccattgacaaacacaaaaacatggacaaacctcaaaaacattatgctgagcaaaagaagccagacacaaaagactgctcagcgcatgattccattcatatgaaatcacagaaagggtcagttgaaggtgcagagacaaaaagtagatctgcagttgcctggggatggggtgggaggttgactgctctgacgcgtaaggaaatttgggggtaggtgggggatggtgggaatattttttgaattgaattgggtaatagttttaataggtaaaatattggaccccacagtatttgagataggtttcagtcaatttagacagtttattttgccaaggttaaggatgcatccgtgacccagcctcaggaggtcctgacaacctgtgctgaaggcagtcaacatacagcttgcttttattcatcttagggagacataatacatcaatcaatgcatgtaaggtttacattggttcaatctggaaaggtgagggaacttgaagcagggagcttccaggttacaaggtagattattctcaacagaaaggaatgtctgggttatgataagcggttgtggagaccaaggttttatcttgtagatgaagcctccgggtagcaagcttcagagggaatagattgtcaaagtttcctatcagacataaggtctgtgttgatgttaatgctggtcagcttttcctgaattccaaaagggagaagggtatactggggcatgtccaaccttcccttccatcatgacctgaactagttttttcaggttaactttggaatgctcttggccaagaagaggggtccattcagatggttgggggggcttagaattttatttttggtttacagtgaagacttttcaagctagacacttaaatgagtatgttgcaaaatggcaatttcttagcacggcgacgtcctaaagaaatgctaaggtaactcaattaactatgctagaaaagagagttaagtatttaggaggatttaatatggtgttaaagttgtgaaaatcaaaatggagacactaatgttaagaaaaccctgataaatggagccagggaaggccatgaagaaagagttctcacacttgtatccctgatcatgaaaaagactctgcaaaaaacaaaaccttgcacaaaggccattgcaaccttacacaaaaaatactactttaaaaggacatgtgcccagcaactgcctgtccaacctcagactggcaatatctttgttattgatcttagtagcccagcataactatttcaaaacagtgatgtaatgctcattttttttcttttgaaaacttttgtcttcctgtaaaaacctttgtcttctttacttaccctgaatatgcacagagtttactatggagtgcatattcctgttgcaatgctctattcccaaacaaacatcattttcttttagagagcctctctctgtttgtgatttaggttggtgatgtaaagcaatggcataactgaacactgattcaaagaaaagtggcttttctctttgttgtattaaaaagaggccttataaataggatagtaagatttgtaagttgaacttaaagcatgaagaaaatttaggggccaggcagggtggctcacacctgtaatcccagcactttgggaggccaagacaggaggattgcttgagcccaggagttcaagaccagtctggtcaacacagacctcatctttactaaaaataaaaaaattaggccaggtgcagtggctcatgcctgtaatcccagcactttgggaggccaaggcgggaggatcacttgaggtcaggagttcgtgaccagcctggtcaacacgatgaaaccccatctctactaaaaatacaaaaaaattagctgggtgtggtggcgggcacctgcaatcccagctactcgggaggcttcaggcaggggaatcacttgaacctgggaggcggacattgcagtgagctgagatagtcccactgcactccagcctgggcgactcagcaagactctgcctcaaaaaaaaaaaaaaaaattagtcaggtgtggtagcacacagctgtggtcccagctactcgggaggctgaggtgggaggatcatctgagcccaggaggtcaaggctgcggtaagagctgagattgtactactgcattccagcaggggctacaaagtgagaccctgtctcaaaaaaagaaaaagaaaaagaaaattatgtttttaaatttataattataataaatttaattacataaatttaagctcaagtaattgtaaatattctttctgtgcacataagttattcttgtattgaccccacaggagctggccattcttcaagtcagaaggcctgagagaggagctgcccaggtggtcttcatggggctgtgcggccagtcatcccccacaggttgacaatccttgtgtacttcatcctcgttggatcctctgtatccctgacgatgagcaactgtgaggcccgtttcagcactgagttccagtcaggaaaacatccacccacccaccacacgctcacacttacacacacattcacacatgcacacacgttctggctccgaaaaagaaaaaaaaaaagcaatttaaaataattctgatcctttgcttatttccacaaactccatgaaaattgtacattgtccaagcaacatttcttaatattctctttttctctcatatccattttccttactgctgtctccacctttctcttccaaactccctgttaaaatccctgccccagcgaacttttattcaattttgtggaatggaggctgctctgatttaaattaaaaaaaaaaaaaaaatccctactccatgtcccagatccctagttgttttttgttttttgttttcctgagacagggtcttgtgtcttccatgctggagtgcagtggcatgatcatggctcactgcagcctcaacctcctgggctcaagtaaatctcttgcgtcagccctccccagtagctgggagttcaggtatgtgctaccatgcctagctaatttttttcttttattttgtagagacacggtcttgccaggttgcccaggctggtatagaacccctgggcttaagtgatcctcctgcctcggcttcccaaagtgctgggattacaagtgtgaggcactgcacccaggctggatccctgcatttttacagatttagcatcacaaaagtctaaacaattagactgactaaggcagaactgcccttatgacagcagacataagaaggaaaaggccaaaacactgtgttaaaaattatccaaatgtgaggaaaaggcaaagagagtaggtgtgcctttttagtgtctaagctgcctgcccaaggggcatctgatgctctcaggcaggagtccacaaatttttttttgtaaaagatcagatagtaaatcttttcagcgtgaagagcatgaggtctctgtcacaaatactcaaccaccattacaacatgaaagcagccaacagacaacacatgacaaatgagtgtggctgtgttccagtaaatcttgattacaaaaacaggcaagaggccagagctgacccatgggccatagtttgctgaccccttctgtaaaggaaagtatttttgtttgacttgctgtttaccattgattgaacacaaggctctgtagagttacttgttaacttgcagaagattgatgagtggcaagtaatttttattcaccagaatatannattattctgttcagtagataagataaacccactgttatattactgtcttgtttagaatgtgactttgattcattttttcacaaattcatattattgccctaatttgtatataagtatgcttcttttaaaaatatatattttttaataaatttgagacagggtctcactaggttgcccagccttttgctataatgagagcataaagtgaatttcacactttagcctagtgcatagatgggattacaggcacaaaccactgcatgcagctaactttgcttctcattccagcacgttctattccnnngnttttcatatacgcgtctcttaatgccgcattcagcccaagttttcttcagtgttaaggtttttgttactctgtgcccaaatgtccttccaaaaaggttaagtttttttaccttcctgccaacattatatgaaagtgtccacttttgtagacttttaccaatgctgactacttttggtttcaaaaaagctctcagtaattttctattaattacttttacccttttttattgagggtgttcaactttttattgttagcatattctctctgggctccattggacgccttggcagctttttggtagtaggtgcctttagaaaagtccttctcgtctggccctttctgagcaaatctagtgaacagaattggctccatgctcagcattgcttaatacggttgatccagggcctaggactcattccttcattaccatccacttgcattgtcttaaagcaaggctctattaatttaatttggcatttcctgtcccagctctttagtttcattaaacaaaggctttagaaaactcccagtagatgcctatgttgcttccttttaaaaaattttggagctgtttccctagcctaaccttttcttcagggcaggagttaagtcccttctactgcattcctgtgaagatggtgattcaagaggcagggcacctgttgctttgtgaaacagtccactctgcagctgggcagctctgttactagaatgttctcccttctggggagccaatattttgatgtcctctgtgaatctcatctgcttatcccatctgtttatgtccttgaagatgcacaggtctgacaccacgaggtagcccttagaaatttgatggcatttctgatgtgtccccaactcttctccaaccactcctcccagagcttgtttcttaagccccttgtggagctgattgctttcctcaaggcagctcagtttttcccagtttgctcctggtggtcctgaaatatgattgactcctgaatactccaggtgtgaaggagagtgggggtggcctttctacttgtcatggcctgggttttaagttgctgtccagtggagcagaggtgactttcccagtgaactacattttttcccctctaaatccttagcaattttgtctccagaggcaagacctggccaaaccatttgtgttgaggattgaatcaagaatgattgaggagatgacagtagtcccccctcatctgaggagggcgtgttccaagcccctcagtgaatgcctgaaactgtggatagtacccaactctatatgtctatgattttcctataaattaatacatgcctgtgacaatgtttaatttataaattaggcaaagaggccaggcgcagtggctcaagcctgtaatcccagcactttaggaggctgaggcctcacctgaggtcaggagttcgagaccagcctgaccaacatggagaaaccccgcctctactaaaaatacaaaattagctgggcatggtggcaggcgcctgtaatcccagctactcgggaggctgaggcaggagaatcacttgaacccgggaggcgggatttgcggtgagctgagatcgtctcattgcactacagcctgggcaacaagagtgaaactccgactcaaaaaaaaaaaaaaaaattaggcaaagaaagaaattaacaacaataagtaatgaaatagaacaattctaacaatatactataataaaagttgtatgaatgtggtctctttctcaaaattaccttttttttttgagacagggtctcactttattgcccaggctggagtgcagtggcacgatcacagcttactgctgcctcgacctcctgggaccaagtgatcctcccactttagcctcctgagtagctgggaccacaggcatgcaccactgtatctggataattttgtttatttttttttgcagagagaggaggtctcactatgtttcccaggctggttttgaatgcctgggcccaagggatcctcctgccttggcctcccaaagtattgggattacaagcgtgagccaccatgcctgccccaaaattatcttattgttctatacccactcttcttcttgtgatgatgtgaggtgatccattgcctccttgatgagatgaagtgaggtgactgatgtgggcatagtgatgcagtgtttaggctgatattggcctgatgatatgtcagaaggagggtcatctgcttcggtgatcctggatcatagagtcatgatgatgtcaatggttggatgtcaggagcagacgatgtcaatgactaacgataagctggacaggtgggatggtggcacaagattttatcacgctactcagaatggagcacaatttaaaacttctgaattgtttatttttggaatttttcattaatatttttggattgcagttgactgtgggtaactgaaactgtggaatgtgagactgtggaaaagtgagggagtactgtattatggaactgtaactctattcggtaggggaacagaattcacatttgtggggcccaggtctctgcatctgtagggatccaattgtttcatttctcgttgtagcaaaaacttggctttggaatcagacagattgatgtttgctatcattctaaatgggtgcagctacactttcctcaagaggtagttctgaaaatttaacaaaatgtgaatttcttggtaaaaaaaaaaaacctcaaaaatattcagtttcctttcctttgtgtctgatgtactccatcaaatactgggaaatatgtgtctctcatagaaatgtcatggatctttgtaattctgattatccacaaaccttggggattagctgtttcaatgttcctattttacagataagaaaatggagcctgtggtaagttaagtgagttactcatggctacttaactaatattttactaggtgataggccagagctagagcccaggtcaccttcttatcaatgctctgccttgtctctgtgccttcctgtctgtctgtatgtgtatgtgcctgttgacagtaaggcatagtttaacccagtagaactaccggtttgtaatgaattccacttgtaaatgactgaccattcaaggaacaagtgttttttctatgcttgacacctgttttggatgccaaaaaggatacaaatgtaacttcagacactctgggcctcattttgcactcattagcatgtccaaaattaaaaagactgaccacaccaaatattggtgaggatgtggaagaacgggaactttcatacactgctggtggggatgtaaaatggtacaatccctttgggtaacagtttgacagtttcttaaaaagttagacatatatatttaccatatgactcagcccttccacttctaggtctttacccaagagaaatgaaatgctgtgcttttacaaatgtctatacaggaatgtacatagcaaccttatttgtcattgcaaaaaacagagacaattcaacgttgtcaagagtgaatggatgagcaagctgtggtctgtctatgcaatggtatcctactcagccagacaaagatatggctaatgacaacaatgtcatgcataagatgacgatggcctgggtgattgatgcaaacaaggataaagaaaataatcaattttgtccccattttcaaagacagatagcagcagcaagagtgtaagtctgaggaaagtcatattccttcctcctacaacatagcacacacacttacaaaaacaatacacagactcctggccaatggacttcaaaactgaggaggatcattaaatttaaatgttcaccgctgcatgaaatctccctgggtcctgccctcccttccccaccctcctccacttgggccggggcacagcagtgattctctcacctctcagagtgagccagtgttggctgcattgaaggctccagatatgcaaacagggcagatattcctggaccagggtgcacagagtgaggctccaacgcaccctattaactgcatgaaggatgaatgagcctctggtatgggctgggacagaaaaaaggattcaaggggcccaaaagggtttgggtggaacctaccaggagcggcagtacagactccttgggaaggtggccatgatttagccacattcaccaataggataatctggagaatttcctagcttgagtttctgggagaaagcagatttctggattatctggtgacaggtaacagggccgagttcatccacagccacctgcagtgttagcaccttaagctgagttccttgcaccaggatgctgtcacgcccagtcagtgtgagacggttcttggctgaaggactgaaaagcttgggtaagtgacttcacctaagcctctatctcttgctcccgtaagtcagggctcattgtggctccttgcaggcttgacttcagggttaacagagaaaatgaaggtacaagtgccttgtgaactctgaaactccaaaccagtcattctcaaagtgccgtccaccagtctagcacatcagcatcactggaagcttgtttgaaatgtaaattatcaggtcctccagagctatgtatgaattagaaactctgggaatggggccctgcaatctatttcaacaggtcctccaggtgattctgatgcaagttaaagcctgagaaactctgtcctatacaaatggatgtcaactcaagctgctcttcagaatcacctatagcacttgttcacccgaatccctgagaatggagcttcaggactgctatttctcaaagtttgcctggtgatcctgagatggggtttgggggacagagatccaaggtgctaccaggtgtgaggaattgttagaaggcaaacctggctgtcatctagggtgcttaaagggtacagatcctaggattctgcctcttacagctgaatcagactttcctagaatgggattgctgtccaatggcatgcctcctgggtgactctgatgtatagcctgggctgggaaccaccagaggattatcttccattgaccaagctgacaaactcgcttaaggctctgagtttcacacttgattttctagcccctgtccttccatggatcacctgcccccttccctcctaatcaggagcacagtcagtggatgcactaatgtggcctctccttggctgcagggaacaggtggaaatgtggccataggtgtgcagggctgcctgccatgtattaatagctacagatttgaaagatccaaggacaagagactagaaaaaaatttaaaacagccaagcattggcccagtaatggcatttcagaaatccaccaaaatattaagatgctttttgaaaaatatccagagcactcatgtaaaagtgcttaattattaataaaagctgacatgtgttgggtacttcctgtgggtctggcactaggctaattatgtttttaggagttgactcaaatgctccctgtcataattatgtgaaaaaatataattattagctccatggtacaaattaaggagaggttacataaataaaaaggaatgatactcaaattagtaaccagagcccatgctcttaaacactatgctattatttgtggactcttacataggtggcaaaagtcaaaggctagattgacttctgtccacttccagccaagatgaagtacaagattcagatacacccttccgcattaaacaacttaggaatcagacaaaatatacaaagcattgtttgttacacattggataacagacagcactagatagtcgtgtctgagaaaagcggtgaaatgagctgagtcttagaattgccccagtttactaaggggcatagtaagggcatagctgcagcacaaagaagcagaacccaacagagactggcgttcacctgagttgagaaaaccaagttgaaaatttaggaacactaacacagatatgtaggcaagagtatcagagaggagacagttgtagggaaaaagagagctttacagagagacagcgagagctccagagacccgcagaagattgccctgacgtcactagctgagtaccgatcagtgcatacatgtaaggatattactcaatatgtggaaaagaacagaaggaatgatgtccaaagctcacccaaagacaggaatcatttatgtttccaccagccagagtggaacaaccttgtaacgcatatggagtactcaaacgaatatttcctcaataataagttcaaattaactgagactaaagcctgcccgctttgtctggacatgcctaacaaagctttgagggaagcctcaaaagaatgaaaccgtgtccaagtaatttaactgtgtcccagaaaaaaattcaagaacatttaaataaatattaaaatatgatcaaacccagcaaggttaaattcaaaatgtctggcatccattaaaaaattaccagccttgaaaattggcgggaaaatattattcataatgaaaagaaaaagcaatcaacagaaacaggcctagaaagtatacatatgataaaattagcagacattaaatggttatgattaatttattttatatgttaaagaaggtagagaagagcataagcacattaaagagagacaggaaagtcccagtactcacacagggccaggagcagttttcaccagtcaggtgggaaaacttcatatttcatggagcattggtagagtacacagtgtcttgccttagtagagggataaatgctgttctgttcccgcctaacccatcttgaaagaaaatctgaaaggatcaaactgtattcaagtaacctaatcacatcccagcacacagctcgactagttataaaaacacaaaatattaatatctagaaacacaaaaataatatctagcacccaacaaggtaaaattcacaatgtctagcattcaattgaaattttctaggccatcaaagaagcagtaaaatatgacctataaggccgggcacattggctcatgcctgtaatcccagcactctgggaggccaaggtgggtggctcacccggaggtcaggagttcaagaccagcctggtcaacatggtgagacctcatctctactaaaaatataaaaattagcccagcatggtggtgggcgcctgtaatcccagctactcaggaggttgaggcaggagaatcgcttgaacctgggagaaggagaccgcagtgagccaagatggcaccaatgcactgcagcctcattagagaacatcgggaaggaaactaaaggcttatttaaagcgcgagaccgtggcgcctttggactggaccctttctaatgatcatttagtatcaggctatgtgggagttgaccgttttgcatagcctgaaagccaacagtatcactcctcctctaggtgtggcagagatgtgagagaaggagactgacagtctgtgggtgtgtatgcagtgttgggggaagcgaggcacaggggacaatactgtggtgtagaaaactagtctaaggtagcatcaggaaattcatgaaaccaaaatgaatttcataacagcacaagacattatttgtttttgcctccctctcatttttttttttttttgaaacagagtcttgctctgtcatccatgctcgtgtgcagtggtgcaatctcggctcactgcaacctccacctccagggttcaagcaattctcatgcctcagcctcctgagtagctgattacaggtctgcaccaccccgccggctagtttttgtatttttagtagagatggggttttgtaatgttggccaggctgccctgtcattttttttttactagtgtccagtggagttttttaggggctacataacatgatactgtcattaatctaatggctaatgaaagggatatgtatatgtttttgtgtttaaaacaaacttctttggggtcctcaataatttttaagagtataaaggggtcctgagatcaaagagtttgagttctgctggactgggacagtggttgtcaacccagattgtacattagggtcatctgggaagctttaaaatagtactgatgcccaaccttaccgcaaaccaattaagccagaatctctgtggatgagaagtcttcattgtcatcatcaccatgaccatcatcattgtcaccgtcactacaccattatcatcatcatcatatcatcttcattatcattgttagtatctccatcaccatcatcagcatcaccattattatcatcatcatcatccccaccatcatcctcatcggaacttcacctgcatggaggacaatccactatgcattaggtgctatgctatttgctatactccttattctcacaactgcccagagaggctgatattatctcactttataacaggaggaatctggatcggaaaagttaaggtaagctaattcacagagcgagaagagatagagccaggattcgaaaccagttctctgctacatcaatgttcccagtccttgcactattgagaacctctttagttatgctttcacccctccaacaccacagtaaattttttctttttttaaaaaaattatactttaagttatagggtatatgtgcataatgtgcaggtttgttacatatgtatacatgtgccatgttggtgtgctgcactcattaactcgtcatttacattaggtatatcttctaatgctatccctccccgctctccccaccccatgacaggccctggtgtgtgatgttccccaccctgtgtccaagtgttctcattgttcagttcccacctatgagtgagaacatgtggtgtttggttttctgtccttgtgatagtttgctcagaatgatggtttccagcttcatccacgtccctacaaaggatatgaactcatccttttttatggctgcatagtattccatggtgtatgtgtgccacattttcttaatccagtctatcattgctggacatttgggttggttccaagtctttgctattgtgaatagtgccacagtgaacattcatgtgcatgtgtctttatagcagcatgatttataatcctttgggtatatacccagtaatgggatggctgggtcaaatggtatttctagttctagatccttgaggaattgccacactgtctaccacaatggttgaattagtttatagccccaccaacagtgtaaaagcattcctatttctccacatcctctccagcacctgttgtttcgtgactttttagtgattgccattctaactggcaccacagtaaatttttatagattttataagcaaattgtatttactgtgcaagaattggtttattttttaaaccatgtgttgcaaacatacaatggttaattgtgatatttgctcagtacaagatcatcagatcactacacagacttgaggtaattccacctaaaagcaaagagaactgaccccacattaactgagaagtctttacttatttattccctataaacgagccaatatgaagagaaggccttaatgtggttaactatgtaatttttttctgactttttgaaatactgagaagagctcatgactctcccatctcctaattctaccttggtggattttagactgaccacaactcatgggtaaatgagggaagacgaataagaaaccttgcttttttttcctccttgtttttggctggctgcagtggctcacacctgtaatctcatcactttgggaggccaaggtgggaagatcacttgagctcaggatttcaaaactggcctgggcaacatagtgagaccccatctctaaaaaaaaaaaaaaaaaaaaaaaaggcgacgggcggtgcgtgcctgtaatcctacctactcaaaaagccgaggtggaaagatcacttgagcatgggaggtcaaagctgcagtgaaccttgattgcaccacttcattccagcctgggtgacaaagcaggacgctgcctcaaaaaaacaaaaacaaaaccttaattttttggctattcttttctggtaagaatggtatagagatggggatgaggatggctattgtatgagagagcaaacagggtccaagcagtgctctgggctgtctaaggaccagtagtcagcttaacttctcaaatttccagggaaggagttcggagtggtagaatatcctgggtatgcccaaagcatcaccttgcaaatagcctgtcatgaataatttgtttcatttgttatgactggaaactggctttgtgtatgccagagaatgggggcaggaaagagagattggtgtcttgagctctctgtgcctctggggcagtgatgcttttcctctcatgtggaaggagagcatgactgaaaaggtgcacaaataaggtgtctgtgagagaaattaaccttccagatacagagacacaaccttccccaagaggtcctcattgctctgccttttttccttttttttgcttgttctaccattaataacagaaactgattatgacctcaaaagagaggagaaagcgactctccccaccctagagctagttaaccaccatatcttcctagatctcagttcaagagtcacttccatccccaataaaagcccttgagtgctgagcacctctccgtcatagcatttgtcctaggggtttttgtacattttcttgtgtgaaacttgggttgacatctgtatttccgactagattacagtttcctcaagggtagggatgtcttgcttgccattttcagttccagcatctagacagtacctcaagcaaacaaggccgaggggggtgcggatcacgaggtcaggagttcgagaccagcctgatgaacatggtgaaaccccgtctctactaaaaatataaaaattagccaggcgtggtggcaggtgcctgtaattccagctactcaggagtctgaggtaggagaatcgcttgaacccgggaggtggaggttgcagtgacctgagatccactgcactccagcttgggtgacagagcaagacttcgtctcaaaaaaaaaaaaaaaaaaagaaagagaaaagaacatcaaatgaatgaatgagtgagatgaatgagttagcagtgttggatttaagtgtcagattcttcccagcttgacttttttctttggcttagtgattttgaggtcncaagatttattttcctttcacaaaggtgatcactaccataagatcttcagaaaaagaatgtggcaagccangtctcactaatgcaaatctctataacaactgtatcagtactgaggtgtcataaatatggaccgatagatgaatacaggtaggatgggacacaatctaagatcccaggggggggagaccacacgcttggttagggagacccaaagtggaccgtgtggccagaagagtcccgcactgcactctagtgacagtgcagaaagtcactgtgggaaatctagaagtttctacaggttgctatttcatcatagcactgtgcaggccaacccttcctgctccactggctgttgggaaaagctttctcttttcttcctagccagggagctctcaaagtgttccactctctcacctccacccaggcgtccaggtgtggaggacacttgccggctgcttgtctgctgactcatcccttggtttcacttggaaaacctaccaccagctggcctctttccaagcatcagcctcctcattttcttaatcccttaggtgtgatctcacctccacacagtagattgcctcaaggcccaattccaatatgaataaaaatgattattttgtcatcttccaatcttccttttaaaatattattttataattccctttaggaggatcacctaagtgaagactatttttacctaagaaatgttaaaatgtaaagacatggttgtaatctggggattcctgttaaaatggctagcagacagaagtcagacgacaggctagaaatgtgtgaagagtggttgcctttgaaaggcggagttggtaatgattttcttccatttttccatgctttccaattctctacaaaggccttaatattacttcgataaccaggacctctgataacctgcccccaccgagtaaagacttagctgggaaagtcagcttcatgtgaggtaaaaggaaccaggtaatacacaattcccactgccaactgtcgggtgtgcaggcctgagcttcctgcatgtgggaggaaagagaaagaagagagaaactccaagatccaagagatccagcaagaaggctggagtctgaggacgcagaaagctgaatggcacagttaccactattgtgctgaggttctgtggcctctgggtctcttgacaactgggcaaagacccacagaaaactatctctagaccctacctgtgggaggggaaagtgcttcagatcatctacaggacagccacctggacctcaaatggcttacagttccttcatccagagggtcttcatctagtacataccaggtgctaagcctgggtgctggagacatgacggggaacccatttaccatggctttgttactgtgacattcacatctagggaaagccagcaaaggggagggatcgaggagagcttgttaggcagagaaaatacccaagggcaagggagaagccagcctgttctgagcacacacagtggttccatctaactgggcctcagtgccaggttggactggagatggggctgaggagctgtcacagagcattctggacacagatgtcacatagtcccttgaggttagggtccttaggcatggcagcattgctttgagtttttccttttgtaatgttgccattcatgacaatgtggaagatgggtccttgcagagaagggcagggctgtgagaccagttaggagactaagatgtgagccaaggaaaatgaggaacacctgaacactggggcaggtgcagggcccagagagaagcagatggcttcctgaggttttaagtaggtagaatcaaggcagctggtaaagatcttttattacatataaactggaataagccatctgctccaagacaaaagagtaggcggaaaacaatacaagacagaaatggaattagaacaaacctgggaggaatgtggaattagagtagagagtccaacactggctgcaatcataaaaatgtaaaacaaacaaaaatttgctaggtgtgcttacttagaaataattagctgtcatattaagttcacttgtgttatggcttaaatgtgtcccccaaaatgtgatgtgttggaaacttgatccccaatgcaacagagttgagagatgggacctttaaaaggtgattaggtcataagggttctgccctcataaatgaattaatactgttatcatgagagtagattcctgataaaaggatgatctctgcctcctccccacagccctcttgtgcatgctttcctgcctttccaccttctgctatgggatgacacagcaagaaggccctcaccagatgcagctccttgatcttggactttccagcctccagaactgtaagccaaacaaatttctgtttattataaattacccagtctcaggtattctgttctagaagcacaaaatggactaagatcattagattatcattttttatcagactgttgaagtgaaaaataaaaatcaaataaagaaattaagagagctgcatgcagcagctcatgcctataatcccagcactttgggaggccaaggcaggtggattgcctgagctcaggagtttcagaccagcctgggcaacacggtgaaaccctgtttctactaaaatacaaaaaactaggccgggcgcggtggctcacgtctgtaatcccagcactttgggaggccgaggcgggtggatcatgaggtcaggagatcgagaccatcctggctaacaaggtgaaaccccgtctctactaaaaatacaaaaaaaattagccgggcgcggtggcgggcgcctgtagtcccagctactcgggaggctgaggcaggagaatggcgtgaaacccgggaagcggagcttgcagtgagccgagattgcgccactgcagtccgcagtcccgcctgggcgacagagcgagactccgtctcaaaaaaaaaaaaaaaaactagccaggcatggtggtgtgtgcctatagtcccagctacttgggaggctgaggcaggagaattgcttgaacccaggaggtggaggttgcagtgagctgagatcataccactgcactccaatccagcctgggtgacaaagcaagactacatttcaaaaaaaaaaagaaagaaaaagaaaaaaagaaaagaaaaagaaattaagagaagggcaggtattaaccccaaatatcccaccatagggacacattaaagtttgcttggccactcccctagcataatatatggaatgtcttcaaggaccctctgttgtaaatacaaggccctgctggacttaatacaacctgcaggctttgagatccctactctgttgccatctctcataggatttgcagaccaaatccaaatacttaaaatagcaacactcacaaacatgcaaatcagagcagaaaagaaacttctaaaaggccctgaaactacactttatgagagaagacaatagggacctgagggtggtagaattttctctctatgcatctatgtttccagggctcactttctcaataaactcttaaattgcttttaaagtaagggaacaagcaaacattacatttaagagaaatcaatttcataaagaaggggggatgtccagggtactttgcttccatgttttgcttccatgaatttgtgtttaacagaagatgcagaaaaacacacaattattgcaaaatcaaggaaatccactctaaacatcccttggtttcccaggccagtgtcacaactgaaaacacatattgtggctaattatgtgtcacaaattagaatgacaaggcaagaaaaaaaaaactctctgattaactaatagcagccaacacagacagcctgtgtagctcgactctgctggtttataaaaggcagaagaagcaaacggcttctgtgaccgcaacaggaagggcctctgctcttaataaataaataacatttaaattattctcccccatttgcaaagcattttccaactcattatctcatctgaccaggtattattgtatctgaccaagaacttgtatacnaaataaagaataaaaaataaatatgggccangcacagtggctcatgcttgtaatcccancactttgggaggcccaggcgggtggatcacttgaggtcagtagtttgagaccagtctggccgacatggcgaaaccccgtctctactaaaaatacaaaaattagcccggcatggtggcacatgcctgtaatcccaactacttgggaggctgaggcacgagaattgcttgaactcgagaggcggaggttgcagtgagccgagactgcggccattgccctccagcctgggcgatgagagcgaaacttcatcgaaaaaacaaaaacaaaacaaaacaaaaaacaccttagaagaagcgttcctcctcttgctttctgaagacactctacgctgaaacagtaactttcaataaaccatctcttctcaccgcactctgcgacttgccttgaattcctttgtgtgcaagatccaataagcctctcttgcggtctggatgagaaccctttttttggaatactctgacacaacaaattgcagaaagaaagtctcacatgtataaaataagcaaaaagattctctggcatctgaagaaacaatttccttgtcaatattagtatcactataagtgtagaacaacctgttgtatgatgctacataaagtatatgaatctgaatactgttggatacaaagggagactatnnaatgtaatacgtcgcccgaaatgactacactgttggtgatctttctttcaagaagcanaatattgcctcnaacatcctgtacatggtataaaattttacccagcaagaacaccaatacaacggggggggcgttctttgtgaggggtggggaggtcaattttttggaacctgcagcaggtaacacacaaaacttccacagctgctaccagctttccaggagagcctgtgtacctggagaggagaaggcaagtgcttccgaacttgacttgatgtcttagattctgcaatgcgtagtctgtagggacaggctgtagcttatcctataggcttgggctggagtcagcaagcatctgggctggcagaagataaaagatgcaaaggtggaggaaagcatacgtggtctggaagacagacttggtgggtgggtggctgctacaacaccctagttagaggtagaggggtaagtcagtgtgtcttctgcacaggcctcttccccacctcattcttcatttcccatacagccttgctgagttattcacaaacatctgattcaactggaagctgggttgaggatgacctaaaggactagtgtgatgcctgcccaggggtgtgggcccatagtcagagtccagagcctcctctcagcttttagcacatctcacccacatcctgggtccttaattagcaatatgaaagcaagccaagtgacaagattttgtccctgggaagtccagaagcactccttttctcatttgtataagcataatgatttgcttacataaataatcatgaaaattcaaatccctctcagaaatcaggtcataaaaccatgaaatgcagcatgtgggcaagaatcacagggaaaggtaggtcttggaaaagaaaggatggcagggaggaagaaagcagggtgccaggggccctgggctgctgtccaagtcaggtggctcaccgtctctgagaacatttcactttctggtaaatggggcagttggagatagaagggttgggtgaatgccaagagtgagcacagctgaggtcagtgctgtgcctgcagtccaggcgggagtagaaatcctgggcccatcttacctccgacctcatttcctcctctgtaataatgtgggggtgggggaaagttctggtcatcagccctagcattccatggttcatttcctcatcagtgatggaaaatcaccaagcaagagaacaggatggagaataaccggatgggtgcaatcggaggtgctatttcaggtgaggtggccagggaaggccctctgaaagggtggcttgagcaggtggctgaatgtacagaagctgccaatcatgaaagatctggggtacagcatgccaagcagaggaaatgcgagtgcaaaggccccgagattggatgtgggcttagcacaaatgtggcatggcaagaaggccagtgtggctgaagcagcatgaacaatgggtggaggggctgagaggacagaggagcaggaaagagccaggcttgggtaggagaggtgtcaacttgatatatgatgcaaagcccttggaggttcccaaacacaaaagcaatgatctaatatatggttttaaaaatgccactcttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaggcggagcttgcagtgagccgagattgcgccactgcagtccgcagtccggcctgggcgacagagcgagactccgtctcaaaaaaaaaaaaaaaaaaaaaatgccactcttgctgtgaaaaattgaccctgggggaaggaggagtagaaatgtcaaaagtggaagcagaccactcaggaggtcagggcaatggactgtgcaggagagactgacatcttagactcgggcaataggagagaaggtggtgaggattatattctgggcataaaggcaacagaactagctgatggcgtcaacgtaggagatgagggaaagaaagaaatcaaagggcattcataggtttgagggttgagtaactggggatatttaacagaaatggagaagtctggggaaggggcaagtattgtgggggcaggggtcaaaagttctgtattttggccaagttaattaatatttgagatacctcttaggtgtccaagtgaagatgtcaaacagtcaattgaatacaaaatctgaatcttagcccaggatggtctcacacctgtaatcccagcactttgggaggctgaggtgagaggatcacttgaggccaggagtttgtgatcagcctgggcaatagagcaagaccctgtctccacacacacacacacacacaaaaagtcatccaggcatggtggcacatgcctgtagtcccagctactcaggaagctgaggcaggaggatcacttgagcccatggttcaaggctgcagtgagctataatcacatcactcaatactacactccagcctggatgacagagagagacctcatttattaaaataaaatttaaaaaaattaattaaaaataaatccaaatctttcctgagattcatattcaggagtaactgtcatgtagaaggcatataatgccatgggtcacatgataccatctaatgaatgccactggaaaagagagaatagctaaaaactgagcactgggcacaccagcacagtgaggttggaaggaagaaatggagctaacaaaggagacaaaagaggagtagccagtgagaagagagaaacatctggagagaagagagagcagcaaaaggtgggtgaaggagaatgtggtccaccaggcccaacaatgctgagcagttgagtaagtgaggacctggccactgaatttggcaagaaagaggatgtcagcggccctagaacaaaagtgaagaagagcttgaggacggaagcctgacaggagtgaactgaggagagaatgaaaggtggagacatggagccaaggagcactgagactcccttgagtagttttgctgtaaaataaaagtgagtgcagagacggggcagggggacagagaaatgcaggggtagctggagggagccacagaatcaaaagagggtttttgtgtttaagatggtagttgtcacatagcacattagtaagttcatgtgaatcacaacgtaggtgagacagatcactaatgcaggagtcaaatccttgcagagcccccagaggaggtgatgaagggaagtgatggacatcattcagatgcaagtaggttagcaattcctggggtacaaataggaggtgactcctttctgattgctcctgttttctgaatgagatagcacataaagtccactcagccatgttagctgttgaagtccttgtggctgtcatgcctgtacagactgggctctcctctccagcatttcctctcagactaagctgagctgcactagccgctgccacatcctcttggggccatcctctgccacactccacatattgctgtggtttgcttgcaacccctggaaggtcctactggctgctcctagaagagtctgggcggcatctctcccttactcgttatcacatggtgctgtaagcagtggccacacactttagctggtgggatgggccatcacaggcagtaaatgcgaaagactgctcagattttaaagcacccatgaatcagtagaatgagtttagaattgtagtcatcaacacacattaaaaaaaaaaaaaacaggcactaaaaaaattagttgagtaggataaagccataaaagatattaactacaacccagataggaggtgcaaaattgtccttacataaatcagatggaaaaagttgaaagcagataagataaaataggtaagcatgacatttaaaaggtattcatgggacgtggttacaaaaccaactcacaactaaaaagtcttaggacctctcgctgacttaggagcctgatcccaactttgagaatgactcagtgtgttaccctgtggctagtgtagaccaatgatcctgtctcagagtcactagccaacagcccatatcaagtaattgaaactttgactcagaaacctcagtgtcagaacctttgacttaggaaccacctgtagtggttaactgcaatttgcaccccttagttcagggctttacaacaccgggggcggggagggggaaggcatagagctgatgacctaaaggaaacccattgcagcaacgcttttgtgttaagtttacaaataagtgttgttttagaatcctccaggtaatgcctttgttatttaatgtgtctgagacaattctgcacattaaagaatataaaatattaccttgtaattccaatttgaaatgtgtaattgacattagacttctattttaatttgaaatgtctaaaacaatgtggttaagtttgtaaaaggtgtgtgaattttgagtctgatttactacatttttttttaattttctttttttttggagttttagggattgcttagatggctagaaagatcgctaggcacatgtccgatgtgtgtacgtgtgtgcaaataccgtgccttttttgttttcttttgttgaaacagagtctcactctgtcgcccaggctagaatgtagtggcgtgatgtcagctcactgcaacctccgcctcccaggttccagtgattctcccgcctcagcctcccaagtaactgggattacaggcgcccaccaacacgcccagctaatttttgtatttttagtagagacggggtttcaccatgttggccaggctggtctctaactcctgacctcgagatccacccacctcgacctcccaaagtgctgggattacaggcatgagccaccatgcctggccaatactgtgccattttattatcagggacttgagcatccatggattttggcatccataggggtcctgtaaccaatactgcacaaataccaagggacaactgtattctaaaaagaccaaaaattaataagcaggacgctgaaggtaattgccccaataaagtcatgatcccttgcccagtgtctgaacctcagccagttttcatactcaggacctattggctgcagaggtggtaggaaccatatgagaatcctgcaatatcatggcaagtatgcactttaatgatatctgcagtccttccccaaaaggaccttacatttaccatactgctatgtcctgcgtgagagggtaatactcagattttttttttttttttttttacacaacgtcttactgtgttgcccacactggagtgcactggctcgatcttagctcactgcaacttctgttttctgggctcaagtgattctcctgcctcagtttcctgagtagctgggattacaggcgcccgccaccatgcctggctaatttttgtatttttagtagagacggagttttgccatgttggccaggctggtcttgaactcctgacctcatgtgatccgctggcctcccaaagtgctgagattccagcgtgcgcggccatacccggccgggaattctttatatattctgaaaactaatcctttgtgagacataagtgttgtaaatattgtatcccagtttgtggcatgtatttttaatttttaatggtgtctctcaatgaaaaaagcttaacacttaaatgaggtcaaattgatcacctttttatttatggttgattcctttggtgtcatgtgtaaggaatgttgttccttcctgtcccaaagttgcaaagatttcttgtgtattttgtcctaaaagttttaaagttttgcttttcccatctgtgcacatttcacatttgctacatctcactgactgcttcctctgctgcagagcaagctccatgagagcaggaggcatgggtcctgcttcttgttggtccccagagccctatgtcatgactaggacctggcaggggactagtgagtagctcctgactaactgactcaatgaatgaatgattggatgattgaacaaagtggtatgggagttcacagcgagtaagagatgccttagaagagatgaagaaggagatggtatagggtagtggttctcaattctgggtccatggtggactcacctggggacccttaaaatgtaccgtggaggatcccagcccaagagattctgtatgactggtctaagatgtggtctgggcaccaggtgatcccagtgtgcagccaggcctgaggccactggatttggtggtaaatgaggtaactatcaagggtacagacgttggttgccaacaggcttgggcttgaatttaagctttgtcactgacttgctgtgtcctcctgcactcgttgagcctgttttctcacctgagagatgggtgtgataacacctacctgctgtagttgttgtgagagttagaggagataagcatgttcctggaatgaagtgtgttcttaatccatcataggttttttgcttgtttgtttgtttgtttgtttgttttttccttttcaagaatgaggttgagccagactttgacagctgggtgggaagtgaacatgtggtgattgggagagaagggcagtttatgtgaagggaatgtaataattagagagtgggcgtgggaagacatgctggggagagtgagcaggccggttagccctggtagagggtgcaagagagcagtgcggaatctgccagggagacaggtgggtgaccagggtgccaagggtgtggcttttcccaggttcccatggacacagccatcctcccagatgcccagcctagctgtgagtgagcaagagttctggattgtctctctcactctgtctttttctctcattccagaaacaaagcagtgactggtacttaggaggagaatcaggtcaagttgggagaaacttgcttctgctcaggggagcagaagcaagaatggaggccccacccatgctggaagatgatgagggttttggttcagggaggaggaatattggggatctaaaggggcctgggagtggggcaggaccctgccttaggacaggtagaaacattttctataaaaaatggggtggaggttgatggtaggaccaggcatctttagttggctccctggagtgtcaagcccttgagatggtctttaaaagccatgcagtggggtttgaatctggtgttcaagctcataggttattaacataatgacacttggaaactatttgggagagctcaagtgagtggcctggaagttctgtgttggtgcaggaggtgacttaggatgtgctgctccagactcatatctttgactgcacacctgatgcttcatctggctatcctgtaagcaccttcaacttaacatgtcctacacagaactcttgatattcctgttcctcccccagttcctcagttcttaccaaatgttcttccagttacccaattgctcaagtaaaaaatctaagtccttctcttggatttctgcctgttccctcaacatcccacctatccatgagtgttctgtgggccctgcctctgaaataaatcctgcctttgtctcccagttcactccagccacccatcctggggctgcaccctcctccttccaagccctctccctttccttcctggtgctgcctgtcatgtcaagcatatgcatcagtgcgaccaggacatttgaaatgcaaccagtacaattgggcgcggttatgcctaccagtttttcttccttaaacattttatatttatgtttgaaagcatgccacctttcttcacttgccaacttgacagatttattagttgacaacatccgctgatagcatcagtaataagttaattgtttttgcacatgtagctttaattattctcattatcatttataggagttattctttgtaaagggtaactgagttttccaaaacaaacagaaatttggggtgggcccatggagcgtgactcatgaaatcagattcttagaaggacctcggcaagtctctgggttgctgttaatgagcctggctggctgccaggggtgtgtctgccctttatgaggccaccactgttcaaatgcttgcctgcagcattacttgcctaggtagtgcttgtttctactgaactgtcagggatccaattctttgtggtctaagtaacaatactcagattcacaaggaattgattaataagccagaatgccaatgtattacatttttgatgaagaccatatttacagtgattgtatctgctcaagctcaaattaggattagagttctgacaaatacatatgtgagaagtatgaggttaaatacttgaaatttggacttttctagaaaatctgaatgtgattgccattcacatacctttctggggatgatgattcttgtacttttattttaaaagacatagaaaactaacttaagaatcagattgcttggctgggcacagtggctcatgcctgtaatgccagcactttgggaggccaaggtgagtggattgcttgagctcaggagtttgagatcagcctgggcaacatggtgaaatcccatctctaccaaaaatacaaaaaaaaaaaaaaaaacaaccaaaaagaataaattagctaggtgtgatggtgcgtgcttgtagttccagctacttgggaggatgaggtggaagaattgcttgagcccaggaggtggaggtttcagtgagctggggttgcaacagtgtactccagcctgggcgatagagtgagactccgtctcaaaaaaaaaaaaatcagattgctttattgctggttttctttctaaaactgagattgggtcccatcatcccctggcccccattggttaatggttcctcctttgtctattgaataaaatacagatgtctgcttttggcaacatggttgaatgtagacactgcagggtcttcctgactcaaaatgatttaggcttagataaaacacatttggaaatgcatttctggattaacaccaaggaaaggagatctctttaaatcccctttctgttcccccctccctaccccctccaattgggcttaagtaagaagggtggttacccgctagtaaacccccttcgaagggggtcttctcctctaagggaaaacccttgttttgacatttgcttcaatgggcccttgtattttgttccttgctaaacgggtgctaaaccaggggcctcctcttaaggcttttagaatatttgcacactttagaaatggaaatgtttttggggggcgagttgtcttaatatttcatttttctagcttgtgtgacatccttttgaaagcagcaattctggcctttgtgagagatggtgaatgcctgcaggtgtgtggaccagtgcgtcccttccttcctacatgcacggcccccagctgggcccagcagagtgctgttacagaataatttccaagggctgtgtctctaacctttggtcttgtcccccattgctgtagatttggccaattgacttcataagtgcctcttatgaacatagatgttggcaatggaagttgaggaccagtcagtggttgttttattgaacacacagcgtaaatcccaacacaatgctgacctaagagaattccagccactctgattctcagtctctttatatctgaaagggttctgttccactttttcccagatcaaaatgtccctgcagctactcagcagagctgtcgcaacttatacgtagaagaggtaacagtccacaaacagaaaggcacaggacgagagtggtctgggtgatgcttcctgtgggggaaaaggtgatgagggtgcatctgcacacctatgttcataggtaagtctgggaggaggtgacctcccctttggttgaggtgctgaggcgtcttgttagaatggcactattccatttatctgatgcagtctgtgggaattttgtggtatggccaccacaggtaccatgctgggaacaatgccagatactgcctgctaagccacagcatgagtcacatgagcatttgtgggctttgggaactaaagttattgaacgatagttatctgaaaaggaatttagggaaaggggactttagtccagcgaacagtttgcaaaccagggggaaggcagccttcagcgtaaaatgaagacgtgtgtgccccaaataacaaagggagagtttgtcttttagagagtaaatgtccacgcaaggttccacttaggcaaatgaaagatgcaaacttgcttagttctgatttgtttacatttgctgaattcggattggtccgtgcaggcttttctgggaactccaaatacatgtatgacctctagtcatacatggcaaatggccgcttggctctaatttgaatttaggcccagttagtcactcaggattaacctttttcagggttcacagctctgaacaatggacttagacctgcaggacataatctgttcctaactctgggactacctgtgccttttgactgtgcccagtgagcagctgtggctctgggcccagacccacagggcgataaggcacagaggtacgcatggagcaggctgtccttgctgagtgatcatgaagatacacttacatagagcagcacttttccttccagtctttgtgatttaactcattagatccttataacaagagtcagtcctctatttaacccatgaagcacaggtggagtccaagcttagtttgtgaaggatgagccaaaaggattcttctcttgtagacctcaagctcagctctctccatgggccctggagtaggtgagaaggcctctgtcttccagagcccactgccaatcatctacattttctgttagcccaattctaggacattgctttaccaactgaagggtgagaactatcataagttataaaaatcaattgaaaaacaaaaaggtacagaacagaaaataaaagatgagaatctattaaacatagtgatgttactggaaaagggggtctcaaaccagaccccaagagagagtccttggatttcacacaggaaagaactcaaggtgagttgcagggtgcggtgaattgagagagtttattgaaagctattccattacaaagtagagcatcctcagacagcaagtggaggaacatgccatcattaaatttttcttatataggaatcttgtctatataaagactaaactaagctgtggctatgtgtgggtgggccgacagcatgaaaacatttattctcctattgatttaaagagaactatccttgacattttagtgtgtttaagtacatcaaagcataactataattatcttgaaagcatatatttttatagggattgggacatctgggctttctgttgttgtagaagtttgtccttgcagggattaccaagccacttccttagctgtaaacatcttagggccatgggtcctgactggcaaggaatgtgtcttgctagttttaagatgggcttgatttgaaaatggtgtccatctggctctcctaggctcctgctttcctaacagtaagggtaaatgctatgttatgaaatgtcatttctgcctttagcttgcaaactcttgatggtgaaattctcctgtccgttttcagtggggtatttattctgcatccacgtcttcacaaggagctgaaaacaaattggatggaagcaactgggttttatgggacacgttaatgttttaatgtcatttggtgtggaattcagatgtccaagcaacattttacactacaaatctgcaactttaataatcactcaaagtacctgaacctcaatgctttcagacagacttggtataaagccaccacctctttctattatggcagccctatcctgaggacacaaatttctgcagggcttctggcatatctctgattaaacaaatgtcaacaaggttaaaacaaatgtcatctctgatttgtttgttttaaagcctggatttactcattgaatatttcactcctactagcatgtcttgtagtagttttcttcagggaccctaattattgctattaaaaatatgtgtgcagctacatgttttttttttatcaatttgcaatgaaaactttaattgaataatctattagtgttattatttgaaagtgaaatcttttccttttgctttcttgttctcacacatagtgcagacagtttccacacgggctcataaaaggaatgattctgccttgtgtgaactttttgcctttattgttaattgcaccattttgtgactggcttcttgaccctgttgtaaccaagctcataatgtacattatttcttattttgcagttgtagacacttgaggaagttcccattctttgtttcttcttgcttttgttccctgtgataactttttcatgcagacattttttttttttttttttttgagaccgagtcttgctctgtcatccaggctggagtgcagtggcatgatcttggctcactgcaacctctgcctcccaggttcaagagattctcctgcttcagcctttctagtagctaggattgcaggcgtgcactaccacacccagctaaatttttcaaattagccaccccacctggctaatttttgtatttttagtagagacagggtttcaaccatgttggccaggctggtctcgaccaggtgatccacccgccttagcctcgcatagttgcaggtgctattctgagctcagggctctggcagctacaagcccaagatgcggtctccaacatgtggccattcaatgtcatggcgccctctactggtcctgggaagcgcagctctgccagtagctccagcagggcacagctgttaagtcgtgatgttctacaggtgaccaaagggcaatctctggactccttagccgctaggtcctctctgtagcaggacccaggagaaggcaggggctgaggatggctctcttagacatttgtgatgaaccaaacgtgtgcattcatgaaacttctgtgagcaagcaggtgagtagagttgggttataaaaagtcttagggtctcactacagagatggacttgctgtgtagatggtgcagagccgctgaagagttctacttggggtaatggtgtgattgggtttgcgttttaggaagatttcttggccagaatgaggcgggcaacccagagcagggagtggccacatgtgggtgtgcagttatgggccactaatccaggtgataaatggtgtctctgaacttcaggtgggggtgccacatgtctccatctgctctgtacccttgagactggccttatgggctgccttagtggtctgttgtcctctatctcctggttgggctcaggcaatgggagatcagagggaggaaagagagcttggttagagtgcacccgcgccccttcaggttggcagtggccacattcccctatacagaaggccacagtttctgtcagtggccctcccacagccccagctttctcagtgggccagccacctccccatcccttgctcctcctcctccagagagggttgtggatttccactgtcagcagtgcctggagctccaccatctcctgctgcttcctctggacctgcctgcagttttataaataacctttccttacattacctctagcatgcaccttttgtgtgtatactctgccccctgtcagcacatgactcatgccaaagagtttgaatttttttctccaggcaacgggaggtcattggaggattttagacattgagaacagatgtgtattgtggaaatatctgtctgactgaagtgaccaggatggtccaaaagagcgagaatttgaggcaagcaaaccatcagcaggccagcagcagaaatccaggtcataaacagggaagctgaggctcacagggttggatcagggaatgggagagggaagccaaacaattccatgagcatgtcagttgcacatatgacttggtaactatttttatttttatttttatgttttgagacagagtctcgctctgtcacacaggccagagtgtagtggcatgatcacagctctctgcaacctctgcctcctaggttcaaacaattctcctgcctcaaccttccaggtagctgggactacaggtgcgcaccactacacccaactaagttgtgtatttttagtagagatgagcattcacgctgttgccttagacacggaatattgattatttgaccagaaattcatgcagctaaccgtgacccctggcaaaataaaatagtgtatatgtacgtgcatatacatgcaaagaaatgagttgaaactagaaggatgtcaatcaaatgataacatggtcatcttggggtcggagtacatttggggatgaggggagctgtaaaagcagacttggaccttttcttctaccagtaccgtgtcatttgaattttggaaagaaaaaaaaaaactcagaaggaggagaaggagcaggaggagaagaagatggatcttaagtgatttgcccgggagcaccttgagaaggtgagattcaagtctaggtctaagctttctaattccatgagtgggagtgacccacgtccaagaggaagctcaaaaggaagatgttctccatcatctcttgctcatcctaacagcatgcaaaaccacatccaatgcagctcagaaaactcccaaattgccaaatttcattggaaacacttaatgctgtggtttccaatttcaactgtaaagtaggtatgtatgccattgttaccattaacttctcagaaatggagagagctctctttccgcctcctccccctctgctgtggctttggtgagacgtgcactcaggctcacctgtctccatgatctccagtaagtacacatgagcagagaggcctcagctcagctcttcctggtcccaccagggttgattctttgagaattctagaatgccacatcctaggccccccaaagaaatcctgcatcttacccccagaaatatgaatcatagcaaatttcaaatcaaccatcgtttaatactcacagactgggcacatccaaaaacatattttcagttttacaacagtgcctggtgcatatcggcactatttgtggaagcaataaatcgacacggagctgaaacacaaacaaatgccaaattgtttttataacacctgattttctttctgtttctttatgcagtttagttttgttttgcttaactctacctcagaccatagtctggtaaactcaccacccagaagctcccttgaaatgtgggtatgcagccactaggtggcaggagagagtttcctgcctggagggaggacagccactctgtccccgggtcaggccagggccaccctgctacctgcaaaattagcatggggctttatgaaccacagcttcctaataaacacaggatctgtttgatagagactccaaaacacgcctacctagtgatgaaagactcaacttcagaagaaaaccttcatggcaaacatcttcagagatgtttccaacttaaggttctgaacacagacgcttccccagaaagccattgtttctcagcacctgggagccttgctttgctttgcttacagactcgctgttcttaaatcactgccaagataacatctgtctcttctcttaccctctatttcgatataaggactcctcactcttgttgcttcctattggctacctctccacagggagaaatcgctgatttaacagcagtcaatatcccaaatctggaacagggaacagggaagcatttaaaaattggagaatttaggccgggcacagtggctcatgcctgtaatctcagcactttgggaggtcgacgtggatggatcacttaggagttcgagaccaagcctgggcaacatggcgaaacctcatctctacaaaaaaaaaaaaaaaaaaaaaaaaaaaaaaaaacccaaaaattagccgggcatggtagtgcacacctgtgagccccagctactcaggaggctgaggtggcaagactgcttgagccctgaggtcgaggctgcagtgagccgagatcacaccactgcacttcagcctgggcaacagagtgagaccttgtcccagataaataaattaaattaatttaattagaggatttaaggattttccctacagacacctccttattttctctggccttttctgactactctccctaactccctgctcctctggtctcccaaaactactccagaaaaaaaaaagggggggagggactaaaggaaagccaggtgacagtgccagtgtgacagatgacaaagcatctgcccgaacaaaccgtaggtccctgaactttctccaagacctgtctgtggacttacctatgaaaaccagttttagcaaaaaccctcctaagccagtttatcaagatccccttatcctcaatatccatctgattggattcttcatcccccaccattccccagtgatgtcaccaggcctttcttcagcaacagtagttagtgggtgtagccaggacgccccctcacccctgatatgcccttttagtaattcttcatccacaggttcccaccctgctcctaggctatacattcccatttgcccatgctgcattcggaattgagcccagttctatactgaggtcttacttcacctctcgccatagtcctgaataaaattggttttcacatttaaaaactgtccagctctggttgttccttgacacagggtaatttttattccatgtgatagtttgccttacctcagcctacacccctcaaacctgcaactctatattcaagaaccagacagccctttccaacagataggaagaggctgccctggtgcaaaggaagaggctctgggaggaaggagagaacccgaaggctgccccctcctctagactgagctctgggatgggtggacgataaaacccagatacgtttagacatctgagcgtggagaggactttgctttgcttccacagggaccccaaggaaactgcaagccctccagagactaaaaacagcagaacagcaagaaatggcagcaaaggtctgggcagaatcatcctatgtgggcacagacacaaacagagtcccctgtggccccaggagagtttaaagaagatccagaggctgtcctattccatatctcagcagagacaggcccgtgagcctaaaagctgatcattaggacaagaaggacacgaactgtcctgcagcgtgaaccgcgtggaacaaggccaatcaccagacaccagaccagccagacacagccccgcagttccccaagaccaccacggacccatcgcccctcaccaatagctccaggctacatagaccccctccacttcatggatgtcctcagagcagaaaggggaggcaggagtggaaccctgacttggttcagttgaaacataaaatgactgtactattattgaattgctgaagtttacgtgaaagaaatgagatttagtttttggccacagtgcaaaataagaaacgaggcttcaactgagattaaggtgagttataggaaaatgtactcccttgaaggacctgtgaagtgtgttcgctatgagaaaatgaccagaatccacgttcttagctgcgggactcaggctgactcctgtttctggagcttgcacaaagggcagggaaatccctgtttcaggcacagtgatttcaatgtttaaaagaaaacaggtgggccctggcaatcatgataacatgtcataagtttacatctctgtgaggcaggtagtgtaatccccattttgcaaaggaggaaaccgaggctgaaagcagctacatggtctcttcaatgtggcccaaatgttggagaacagagcttaactgaatcagcaattctatacttagaactgactctctctttattatatctcactactaccttgatatttgaaatattcaacttttttcaatcaaaaaataacaataatttaggcataatgactactatgtcatttaatttcttgctgatatttcaatatcccatgccaggaatattgaaagctcagctccttaagagctgactatggcatcaactcccaacaaccatccttccagaaatattttcccctttcttttgttatagagtggcactgccctatatggtgaccacttgccacatgtggctgttgaacacttgaaattggcttgtcagaattgcagtgtaaagtgtaaaacacataccaaatttcaaagacatggcacataataaaaaatgtaaaatatctcattaacaatttttatattgactgtgtaagtaacattttgaatatattggattaaatacatggatgatgccccaacacccacagtcccttatcaagtctctacttcacatttttgtacttctgacttagaaatagcactggcgtctaagagcctattaatgtcgtcaataggttcttgggaaccacaattttaaacaaaatgacatataagaaaacgaataacattgaacaaaatgacattattcgaggacctgctgcatgttgtttcacttaaagtcagtgtccaagaacctatcagtgacatttagtgaggacttgctgtccttcctgtttacaggaacctgggcaagttacttaattcctctaagcctggtttatatccctgcaaagagagaaggataataatcaccagtacttagtgatgtcgtaaggagaaaataaaataataaatatgaaatggctgacagtgtccttgtcacacagaagatgtgtgatccacagtagctgctattgtctgcctcacttcactagtaatggtccagggaggcctttaatgtgcatggtgcagtacattcacatgttggacatgggtgaagggaaagaccaggctcatctaaacacaataggatgcttgtggtgttttgaggaggaatcaaggactagttatccacagctgtaacatgcatggatcaaaagagataaggcacacaaaagactttgtcagtagcaaagcattacaaaatgcagagaccagctgtgggtggtggtgagtcagacccagcttccctctgtgcctggctgagtggttctgggcaagtcacgccatctgtcttgatgcccttccccatctatagagagggagcaactgaggccccttccaatactgaagtcctttatttctgctactttagaaatatccacatttttggtaaattcaaatgatccaatgattccatttcctaatgttcaaaactagccccagaaacatctaaatgaatcaaacaaataaaatatttattgtgtatgttttgattgctgaaacttctattttagcaacacacacacacacacacagaacccataagccttcatctttccttggataaacgagccttcctgtctggccatttaagtcacgattaagtaaatgatttccaactcgccttttgcagcagttcagatgggtctttcctgcgtggcagtggccctcctgacttatgatttcctgtgtgtcggcctgttaccactgcagcttaactgaggaaacaagaacaaaacagcttctgaccccaagagactgttggaggcaaaggcttcagtcccaagaacctcacacgtggggagcccgagagcccagccctgaccttttctccagtaataacataagaaacaacaggcactggccttattttggatacaaagagtggtgcttttccttaaatcttcctttagtcagggctaccccttcatggacgccccaacatccatggttcctgcttgagtccctgcttccatattcctgcacttctcacttgaaatatccctggagtacgttaagcagccaggtttggaagttcttgctgtgcaggcgggtgtgtgcatgtcctctctctcaacaggacacaagctccccaaatcagacggtatgcctccacgccccttcccaagcctccccagcagcaccgagcatgtgaggggagctggggcccaggccatgatgggaagcactctctgcctaaagactagggtgatgcgccctcaactgtgggaatgagccccagctctggtgtctgcctcggtttttcctcctggacaatcaacatgaactcctcacccctcttatccactttgcataaactgaaaataacaaacccagggctctttctgtcacaggaaagggtttttttttataaaattaaacagagatgattcaacacacccaggatataacacatgggccatgaatcaagggcagcattgctctggtcagcctgttgtttgggcccccttggcagggctctcccctgaatcttcccctcttgactcccatcancacagcactccanctttgtgttacaggcgataaatgggaaaggggtaaatcattcttaattagagaaacgctcattaaactagacacccaaattctctggggggggatcattcttacaagcatgcccttctctcttaaagagagagcacttttttcgcaaataatgctgccatgaacatacggggtgcatgtatcttcgtaatagaatgatttctattttggggggtatgtacccagcaataggattgctgggtcaaatggtatttctggttctagatcttcgagatcttccacaccgtcttccacaatggttgaactaattcacattcctaccaacagtgtgaaagcattcctatttctctgcaacctcgccagcacctgttatttcttgactttttaataatcgtcattctgactagcatgagagacagtatctcgttgaggatttgatgtgcattttgctaatgatcagtgatgttgagctttttttcatatgttttttggctgcaagaatgtcttcttttgagaagtgtctgttcatgtcctttgcccactttttaatgggggtttgttttttcttgtaaatttgtttaagctccttatagactcacaataacaaagacatgggatcaacctaaatgtccatcaatgatataacggataaagaaaatgtggtacatatataccatggaatagtatgcagccataaaaaagaatgggatcatatcctttgaaaggacatggatgagctggaaaccatgatcctcagcaaactatgcaagaacagaaaacaattgttgcatgctctcacttataagtgggagctgaacactgagaacacagggacacagagaggggaacaacacacatttggggcctgtcaggggtgaggtgggggagggagagcattaggaaaaatagctaatgcatgctgggcttaatacctaggtgatgggttgacaggtgcagcaaatcactgtggcacacatttacctatgtaacaaacctgcacatcctgcacacgtaccccaggacttcaaaataaagagagacaatacttctcccttaagtgtctactgttgctttgcaataaaaacttcctgcctttcacttcactctgacttgtccctgaattctttctcgtgatggtgtcaagaacgtggacactggctggggctggagactcaccagcatccggagaccctcctgagccctccagcaatacaactttgacacaaactatgaaatcacagatccaagaagctcaaagaacccaagcacaggaaacatgatgaaactacatgaaggaacatcagaattgaattgttcaaaatcagtgataaagagtaaatcttaaaagcaaccagaacaaaatatccatcatatacgcagaaataaagataagtatgacagcagatttacaaatagaaaaaaaaacaagtgcagcaacagaaacaaactatcaatccataattctatacctagtgaaaatttctttcaaaacaaaggtgaaataaaaaaattattttcaggaatacaaaagcgaaaaaattaatcactagcattcatcactgcaagaaatgttaaaggaagtcctttaggcagaaagaaaatgatacaaggtgaatatttggatccctgcaaggaactaaaaagatccagaactgataacttaatgggtaaacatgtaattttcatcaacaagtgaatgaataaacaaatcatgatatatccatatgatagactactacttagaatacaaaagaagaactacttatgcatgtgataacatgaatgatattcaaaattattattgagtgaaagacaccagatcaaaacaaagtacatactgtatgattctgtttatataaaactctataaattgcatgctcttctatagtgacagaaagaagatcagtggctgcctgcagacaggaagagattacaaacggaaatgagaattccttaagagatgatggacatgctcattacccatcatatgtatacagccataatggttttacagatacatatatatgtacacgccaacataaatataagttatcaaattacagtaagttctgacttaatgtcactaggttcctggaaactttgactttaagcaaaatgatgtacagtgaaaccaattttaccataggctaattgatataaagatgagttaggtttttggtttttttttttttgacatgaagtctcgctctatcgcccaggcaggagaagaagagttaggttttacagcatgtttctggtcacaagaacatcatcaaacttgtaaataaaggcacaaaacacttctaatattaaatatcaaaataaatatgagttatacagaatttaagaaagattaataaaaacaagtaaaatcattatttatgggatttttggtaatcagtgagttatgtggtcatagtggaagtgggttaagtcaagaaataaatgtttgcaaaacaaaaattttaaagatcctctcctaccaccacacaaaaaacaagaaaacacggtgggctcgctaagcacttttgtaccactcgtatcttatgcgtttgtatgattattgtaaatgctttatgataatttttagagacagggtctcactctgtgtctcaggctggagtgaagtggtgcaatcatagctcactgcagtctcaacctcccggattcaagagatcctcccacctcagcctccagtgtagctaggactacagttgtgtgccaccatgcccatctatcttcttttttattttttgtagagacaggggttgtgctttgttgcccaggctagtcttcaactcctgggctcaagcaatcctcctgcctcagcctcccaaaatgctgggatttcggacatgagccagcagcaccttgcccagcattttatttcataataattataagtcattccttcattcatcttacaacccacttgttccagttcaggatctcgggtgaccagaacctattaacgttcacgcacaagtcagaaaccagccctggacaggacaccatcctaccgcagggagaacttacacacccacactcactcagactgggaccatgcaaagaacctaacgtgcactttggaatgtgtgttccatacccactagaacagctaaaatttaaaagactgaccatacttgagtgttgaacaggatgtgacacaactaaatcttttaagcgcttctgcgtaaatggcacagccgctttggaaaacagttggcagtttttcaagttaaatatacccaaactctatgatccacttctcaacaatcaaacaagagaaataaaagcaatgtctacacaaagatgtatacacaaatgttcattgcagccttaattatactagccccaagttgaaacaagccaaatgtccattaccagatgactggaacatacaaattgtggtatattgatacaatgaaatactacttagtaataaaaaagaaagagctattaacataagcaacaacatggatgaatctgaaaacaattatgctaagtgaaaacagccacacaaaagttacatactgtatgatcacatctacataaaattacagaaaaggcaaactaatctatagacagaaaagcagatgagtggttacctagggatggggcagaagggacgaaaggatggattgcaaaatagcacaaaaatattggagggatgacaaatatattcattatcttgattgtggggatagtttaatgggtatatatagagatcaaagctcatctaattatacactttaaatatatgtatttcattgtgcatcagttattcatcaacaagactataaaataatatatgcctacatacatttttaaatattcaaaatctcacagttatatacataaatgcaactgaatatgtattcagatgttttaacaagcagaaaggactgattaaactcatgacagcggctgtttctgggaagggtgtaggagacaagagatggaaaagaggatgagagccagaagagacccttgtaatgtttcctttcttttagtaaaaatatattgacagttaaagctgagaggtgagaataatagtctcatggcttttgtgtccttaaaatttcacaaactaagtgaaatgggagaaagcaaaaaaataaacttaaataaatgttatattgcccaaaaagagatttaaaatggaggttagacacatgagacttacgttctcaaaaaagtagaatctgcagggaagtttaacaactataaagaattaaaatctagcttctaccagcccaaagcctaaaatgttctgctttattcttccttattataattcataggtaatatattttatgtttgcaaatgaatgcagtgatattagatctctaagaggtgctaaaaatgaaaagtacatattccaatttttcccaattttccttctctttccatgaatgaaaaatatacatatttgatgatttccaagtttatacaaccgatctttctcttagttttctcttaccaaattccctccctcactcagccaccagccagtccaactgtgctacctgcacagcagccctcataccatccacactctcatcaggatcctgcctgacctgcgaggagcagcagcaagaaggagacagaacctccacgctgagcatctcagggctttctcagagactccagaggaccctgatagggacagagcctggccagcaatccatgctgccagctgtatgattgtgggcatgtaaattctcaactgaaaatgggtgtaataataacatgttcttcccagaatgagctttatgaagatcatatagctgtttggaactcagacaagcactggtaggaatacaaacaggggagccaacagcctataaataatactttaagaaagggcatgaatgtaattacttaggaacaaaaggcaaagtggagagatgcctaggactgagctggacaagctgcaccctttagtggctcagcccatgggctgacaaggaaaatggaggagctaccaaagaaggtggaaggattctgggagagtggccctcaccctgcccagggcagggctcagtgggagagagggagatctgttataaatgctgccaggaggtcgagtcatgtgagaatgtccatgtgaaaacatccactgtgtgtatctaaagagagtggctgtaaaacaggtcagggtcaaaggtcttattgtctcagatgttatctgcatgcattgtctcacgaccaagaaaactaaggagcatggacacaaagggttaggttgaagcaaaaatttaataagtgaaagaagaaggctctctgcagtggagaggggagtctgagtgggttgccactttgacagctgaatccaaaagcttttataagaaactcttctcatatctgcagctgtttgagtaacttctcttacctataaaactgtctgtataactctcccttatctatgcagctgtgggatgtctccaggtaagcataaagtgtagcttctcttgtttgtataactgtgggtttgttttaggcaagcccccatcccctccctgtgtaagctcccatggagcccaccatgtgcatatctgagaagtggaggaagctttctctgggagctcactgatcgtacaaagaacaagaggcttctgtgccgcttatctattcaggtgcagcctgagttttccccaggctgctctatttttgcctgtagctatgatttttcaggcaggctgcttctctgaagactagccttaactgtctacctatcagatttttccttttcttctccctcagctggttcccctcaccaaggctgagcaagtgaaaaggagggcacagggcaggccagtagtgagcagcaacaaggaactaagacagcagaaaccactcttcacacctgggttgaaaggggtggggagccaggactacagctcaggtaagaacataggtaaagagatactgttgttgtgttgtttttaactatgagaagcattgagctttaaatttctacaggaaggatccagttcagacaggagcacccaatattcagaagagaagaacatggtgtaaaggtcctgggaaggctgagaggattgggactcagaatccagagcagaagccgtctgtgaacagaagaaggacctcccccagtgtagcaagagggagggaggagggacagatgccaagatggttcaggaagaaggtttggtggtaaatgtgaggctgtgctcacctgctggcttcaattttctctttaaaatgtcagatggaatcatttgatgaaggccatgccatgcaatgaaatggcagtctgaggcatggagcagctccagcttagcccgtgtttagggtaattatggctccaacccaggagatgaatatgactagggaaagtgaagtccaaaaacaaatggtctcaagttgactgtgagtcttctgggaggctgagacgacaggtggggttgacaagggaaggggaacccacctgctgaaaaacatcaggctgttggctgggggaggggtgaggcctgtgttgtagagatggatggatgcctaaagttgggtaaaggtttcaactctaccctctgctgggtgtggaaataaacaaagaccacccaaatgagaacaaacaaagactatttatccagagcttgctctgacaagggagtcggcaaccatcacttgcttggcagagactcagaagtaagcaggggagaaagcctcatagcagaaagaagggaagtcttcatgtatgccctgagtggcagctgtagatgtgggtgagttgcaggtggctaactagaaatgggggactcctgtgtgattgattaggagcatgtttggctttctctggttggtcctacattggaagagggaacaaaaaatttagggcagttgtcagttattaatcaagtgttggccatttttgactgactgttacaggagtgactggctccctggattgtttgctagaaatagtggtcttcacttcctgcaagtctgactttctggtaataggcttcctgggttggctattgtggataataagtgggtttcctgagctgatttctgcagattgtggatcagagttattttatataaacagtctgaccattttccactggcatattccatcttccaagagctggccaagctgctgtcttatctgtctcccccagcccctccactctggctgtgaaaatacaagccactaggtgaggaatggggacaattgaagactgaaagcttttctttgctgggttcgcagagctgaggaaagaaatgacaacatccaagtgtctgccctgggccagttttaggactgtagtggtaatgcaaggactgtgtgagtttatattttcatttgtctctctaactaaggtggaaaaaaaaaaacagaaaattgtctgtctgcagtctctgcaaaagtctaacactgtgcttcccaacattgcagccattagccacaggtgagtatcaagcactttaaatgagactggtccaaactgagatgtgctctgagaataaaacacacagcagatttcaaagacctagtacatgccctgatttcaagctatattacaaagctgtggtaatcaaaacagtatggcattgggaaaaaaatagacacattggtcaatgtgacagaatagagagcccagaaataaacccgtgcatgtatagtcaactaatctttgacaagagtaccaagaatacacaatggggaaagtctcttcaataagtggtgttgggaaaactagatatccacatgcaaaagaaagaaattagacccttgtattacacaaaatctaaaattaattcaaaatagaaaaagacttacatgtaagatctaaaaccataaaactcctagaagaaaacatagggaaagagctccttgacactggcattagcagtaatttttcagatataacatcaaaagtacaggcaatgaaagcaaaaacaagtgagagtatatcaaactaaaaagtttctgcacagcataaacaatcaacagagtaaagacatgacgtatggaatgagagaaaatattgacatctgacaaagggttaatatccaaaatatataagtaattcacacaactcagtaacaaaagccaaataacctgacttttttttaaaatgggcaaagtacctgaataggtattcctcaaaagaagacatacaaatggccaagagatgtatgaaaagctgcttaacataactaatcatcagagaaatacacaaatcaaaacaagatatcatctcacacctgttagaatggctattattaaaaaatgagataagtgttggccaggtgtggaggaaaggaaacccttgtacattattcataggaatgtaaattagtacagccattatggagaacagtatggagattccctaacaaaattaaaaatagaattaccatatgacccagcaattccacttcaaggaatacattcaaatactatcagtatctcaataagatacttgcactcctatgttcgttgcagcgttattcaccatagccaagatacagaaacaagttaaatgtccatcaacagataaatggataaagaaaatcaggtacatatatatatacaatggaatattattcagcaaaatcctgacatctgagataacctggataaacctggaggacattatgctaagtaaaatcaaagcctgacacagaaagacaaataccacataatctcacttacatatgaaatatgaaaatgttaattttatggaaacagagtagaatggtagttgccagagcctgagagtagagaaaatgagatgcttgtcaaatcaaatcatcacattgaatatatataatctatttgtcaattaaatattttaagaataaaaaatacctggcaccaaaaaaagaatgcaaaatgtctcaacaatgttatatgtattgcattttgaagtgataataatttgaatattaggttaaataaaatatatttgaaaaattaacttcacctatttctttccatttttgttaacataggtacaaaaaaaaattaaaattacctatgtggctcatgtaggtggctcacattatactttgatgacactatacaggctggtgaccatatatctcttagactagtctaagtgatttaacagtggttccagaaagatccaggtttaacaccaatgaaagggccagctggcttagcccagcttgtgtgggaaatgttggggagtggtttaagacagggaaaagcaaaacttttgatgctattgactttttgaaaaatcttttgtggctgaaaaaaccaaaacattattgctcgagtgtgtctctaaagcctttcccccattggctccactatacgcactctcctggtttcctcccctctagccgctgtctttggtctcctttctgattttgctgcgtcctctgtcccctgaatgattgcttctccactacggggtgattttgctccccaggggacatttggcaatatctggagaggtctatggttgtgtttgagggtgttgctactgccatctagtggggagaggctaaagatgctgttaatgcccaggacagtccccataacacagaattattcagctcaaaatatccatggtgccaagatcaagaaaccctgctcaaatattagcatgtgctgaaggcccttctctttcctttagcaatatctgcctccttagggatcttttctagtctcagtggtttaacatttaaaatcccaaattaggcaataaattgggccccaaacttcgttagtataaaatgtagaactgtgttattagaaggctaataaaatgacctggtgagcatctgcagctagcctctgagcaattctggggaccacgtgcaagataaatccatctgttccctctctgtaatgtggcgctaccttgtggccgatttttcctcgggttaaatatctctggggatgcaacttgtcgtggttaatggctgtgtgaggccagcgcgtggtgataaaggaatcaatcaagacaatattgaatttagaaaggcagatttatttagagaaaaggagagatacgttgcaagggagcaatgggcaatacagcagagggaaggctgtctgcaaagaggcaagggctacgtatgacgtagggctgcttaggctgaatgcttgcagacaagatgcttgcgtgcaggtgggctgtgagctgagtgcttgggtgctagtgagccattggcagctgaccctatttcttggaacattcgctccctgcaagcattttaatgttaaaccgccaggtcagtttgaattttcttttttctttttttttttttttttttgcctttagtaggacctgccgttgtgagactatctgaggtaaattagacaccctcctggtttaagtcaccgctccagtgactaggcagggagctcttccttgaagagggtgtgggcagtgggtactttgcatgttgtccacaccaggcgagctgctgcttcagggcctttgcatttgctcttttctttgcccaaaatgcacttctctcactgttcacatgatttttctccctcttttccttttagtctttgcttaaatatcaccttctagggaggccttcccacaccacctcttcaagatttgagggtatgcacccccacccctagccttcttatccctctccactgctttcttctcaaagcacttgttacgttcaaataaaatagattagttactttatagttctaattttactattttttgtttacttcatcaatacccatgtaatctctggaaggaacgtttctttttgtagtgtatttctagcacctagaacagtacttggcacatggcaggtgttcaaaagtatttgttgattattttctcaaagggcatggagtcttagaagtttgagaacacagttctaagcacagctgtttagagactatggatgatgctaatggctgtattcccagtaggtggggcaattctcaaattgacctggaatccttgagatctggggacagtcaccaagcactgggctctgtggggagagatgtgctggtttttagagaggagaatagcatcctgggggacttggccccagggctttcctgtcccaatctcttcccaactgagtcccagaggcaggaggccttgtctgtagctggtcagtcctgtaactgtttccctcccatctacacagatgcaaagaaggctgagaaaagcaagctgtcaggtgagcaggggccctgactcctccccagaaggcactcagaacttccatagggcaactggaaagaaggttctacttcctcaccggcagctgttgctggggaaaaaaccagcctcaggccctaccctgtgctgagaacctgaatccagtatcaggttctccaacaaacttggatccagctgaccctcacaaggggtcagatgcaaccttgtagcatatggaaaatggcagcaaggtccttgtgtggactatgcctagaatctaaattaagacaaggcctcagaggggctaagtgacatctgtctccaaagtttcacagctagtgtgtgactaaatcttgattccaccctctcaggttttaccataatcccaaaaaaggttgaaacaagaaaagttatctttgggcaattacctctttctgttccttgctttacctactaatgttctaggctcaccctctggtctgcaatctcactgaactgacagatccctcatggcctaaagggttttcacactgggttgactaggctctcccattgcctgtcctactgtctaaggcacctcctgggtagggtgcccagcgtcattctgatgctgcctgactttccttccagctacttttgaaacttggtatccatggcagaggcttaaagggcatgttccaggtacttttatttccaaattccccagtggcatcaaggaaatcagcatctctggatagctctactaaggcttagttctcattgtccaatctagctcctgggtcatgggaggcattcaggaaatatttgagtgtaagagtgagttgctttacctccagaatatccttccaatggctctgaagcaggctgtggagtcctgctggctgatcacagttcacaggtggctcccaaacctgtggtctacatccatcctttgtcagtgtcactgccattgtcccacaaatgtcatttgggcctagcccctgggatagtaatcagtctttacatagatatacattgtgctttacatccacagtaattctgagtggaccttaaaataaattccatgtcaggtctcaccagcccatgggttacagatggggttacctttcagccttgtaaggtgccccgtctttgagtgtagacatggactcacaacgagtccactcctgctgttcctctgctcttgctgaggcttctgctgctgctgctgctgctttgcagaggctggccagctgtggtgcctgaggcacctgtgtcttcacagcaccaacttgcatggtggccacggtgtagttggaaagggatgcttagatgggaggccaatgggagctgcttcaggaggcaaatccaagtcacagagatcgagtcaccgagagcatagtaaactcaaaatcccttcttctgcttaataactgagatgctgtcactgggttaacctcaccaagccttgttttgtcttcacttagagtgatttctgtcttagaaggctcctcatatccttctggggaaggcttctagtgagtccacagatagctggaccaggcatgtccagaaataatctgattctcacatttgagttagccagcgttcccagctatatccccattttgtgtctatataagttaccaaagcccacaaggatattaggtggctccttagtttgctttatgattatgccttgtgtgtgtgtgtgtgtgagtgtgtacgcctatgaggattccttctctcccgttcttgctatggcttctcttccccactgatgggctgtagttccctgtccttttgactttgggcttagtcatgtgacttttttgccaagggaatgtgggcagaagtaactgggagccagtcccaagctaaggccttgggaagcatggtgagcctatgccagctccctcagaactccttcccttggccatgaagagagaataacctggattgtaccttcagcccatgtcctagaatacaaacatggagaataatgaacttgactcaaaggctgaagggcagctgagcccacatgaggtcaattgaactgcagctacctacagacctgaaagtgaaataaacatgtataagtctctgacgtttggggtttgtttacatagcattattgtagcagaaacttaaataatactgggggctaaatatagtggaccagtgacagcacagaatggtaaaatggagtgattgttacttacatcacaacccttcatctctgttgatggacactaaaatcaaagtggcaattactcagagttgggagtcattgagttgcatcattgttgtttagaatcattgacagtttgagctctaagtgattacagagatggtttcctcagctacaggtaaataaacaaaggcacagagaagtaaagtgacttctagagggcttcattgatatttagcagcagaatcagagctaaacaatgagtctctcatctccagcctttctattcttgtttcctaggttgggattttgggaaatagtgcagagagattagcagtagtgacatggaacaatgtgagcctcagcttccatccctgaggctgccttcatctgccagggaaatgtctctgtgtgcagccttgccctctgcacacagtgtgtatggccacctgaataagtgtcctttcatagcgactaatggattgaaatgggtgctagagcagtgcttctaaaaactccatgtattaatcatctaggggtcttaccaaaaacgcatgcagattctgattcagtaggtctggagtggggcttgacattctgcacttgtaacacatggaccacactttgagtagcaatgtattagatcattccagtggaaacatgtatgagtgatggaatgaacagatataattaatccaggtctggtaagtgaggtactgatacatattaagttgaagtgaatttcacatcaaaaataatggttacacagtgacttttactgcccccaaattctttccttttgagtggtttcaaagtgaactgagccagccaggttaagtccctggtttagtgtgtgattagaagatttgatccagctttctcctccttctaattctttaaatatgcaatggccttctagaaacttgtctctcaggctccccatgagccacctgtcttaatatcttcccccccaggacatttcctgggtcaaggaaggaatcagggactaggaaaagtagaaaggttgcctgacagtgagaaactttttgcactcctatttgttcaattctaaaatgtgggtattgttggggcttctaattggaatctaacctgaaattcaggcatgtctagctatatatgaccaagaattaggatgagttcactagaagcctattttcaggagagcggtcagttaaattgaagtttatgggtttatggtaatgggttggggagtttacttcattagcaatagcaacgtttttgaatcagagaagtgattttgaacacactgtacatagttttctcacttagatttatctctgggtcaacccttgttggacctatattagaatcatttagtgaagaaaaggtgggtgtcattaggaaaagagccatttattcaaatgttctgtttgacattagggcactggcaagactacagaatcaatagatatttaaaaacagccaggtgcggtggctcacgcctgtaatcccagcgtgatttgggattactttgggaggctgaagcgggtggattgcctgagctcaggaattcaagaccagcctggtcaacacggtgaaaccctatctctactaaaatacaaaaaattagccgggcatggtggcaggcgcctataatcccagctacttgggaggctgaggcaggagaatcgcttgaacccaggaggcggatgttgtcatgagctgagatcgcgccattgcactcaagccagggcaagaataacaagactctgtctcacaacaaacaagcgaacatacgaaacaaacgtaacatccaaactagcaggtacatgccgtgccagtcatgacccatggtcataagatgtctacagctcaggaagcagctgcacaatgcctgcatagacaaactcttatgaaagcagaatgtcctgatgtctccataacacataacagtgtatgcttttattatggtcatactctagctgtgatgtacctacgctctaatatgccaacgatagttttctttaaatcatcaacataataaatgtcatgctgtcagtcccccacatgtagacataacttagctggtacatggataagaaacctatattagataaccttaggccaggtgtggtggctcatgcctgtaatcccagcactttggggaggccgaagcgggtggatcacgaggtcaggagatcgagaccaccctggctaacacagtgaaaccccgtctctactaaaaatacaaaaaaaaattaaccgggcatggtggcaggcacctgtggtcccagctactcaggaagctgaggcgggagaatggcgtgaacccaggaggcggaggttgcagtaagccgagatcacaccactgcactccagcctgggggacagagcgcaagatttcgtctcccaacccaaaaancnannnnaaatttgcacccaaatctgactaattccagagccaattccaatttagaatcgttatatctccctggtgaactgaagcttttatctttaaggagacacactctttatgtctaccaatgcttattgccttaaagtccactttgtcagatacagctgctttcttttaattagtttttgtgtggtatatctctttccatcctttttctttcagccttctccattcttacattttagatatatttcttttttcttttttttttgagagagagtctcactctctcgcccaggctggagtagtgcaatggcgcgatcttagctcactgcaacctccacctcctgggttcaagcaattctcctgcctcagcctcccaagtagctgggattacaggagcccaccaccaagcccagctaatttgttgtatttttagaagagatgaggtttcgccatgttggccaggctggtctcgaactcctgacctcaggtcatccacccacctcggctttcccaaagtgttggtattacaggcgcgagccaccatgcccagctgattttagctgtatctcaaaaacagcatgggttctgtttgctttccttattcagctttataatgtaaatcatttacatcaaacatctaatacaccatggactgtaaaacacagccatattttatgtatgaattaaaaaaaaaaacaccaccaattagttcctgagacacacaccttaacaatatctctgtgatgtgcataaatcaatcacatcagtttctctgcacctcaaaatttctttcctcaattctcagagatatggcaatttctctggttttacattcccagaagcaaagaaaaagtacacagcttcttcaagtcatgagtagcttcttttttatagctcttggtgtttgcaaaaaagattggaattgcttcactaatactaaattttcattctgctgctctgtttctatgacaagtcagagggcatctttttgaagacattctaaacagcaattaaactcaaaacatgtaatgacaatgacacacaaaactcaactgatgaccaaatgaagagttccagccaagttgacacaagctggctgacagagcttgtaatacacacagcttggcatatgcctcgccatttcagagatgtaaaaataggaataaatgttttcccttaaatcaatgaaatagagcatttggactgaaaatctacgacagttatagtgttttctattcattattctcattctgtttcttctcccccttgctttcttttagtttgaatattttctatcatttcatttttcttcctactagtttgaaacttatgcatttattttctattttttagcacttacctaaaattactctgtaatccatggatccttaatttatttaaaaaactaatgttaatgagtagctttattttcctcccatctaatttaaggcccacagaacaccttcacttacctcaatcctctcccaacttacatgcttttaatgtcatatatgttaataccgtatacttttaaaactttctaaaatagcattattttatagcatgagtgttcatttacatttttgcatatatttagaattttctttgctcttcgtttcttcttctatttatgactcccctctgggatcattttccttctacttgaagtacatagtttagaactgcactattcaatacagtagccactagccatgtgtagctattgaagtttaaactaagtaaaattgagtaatattaaaaactcagttccttcatctcactagccacatttcaagtgctcagcagccacatgtgactaatgactactgtacagcaaacatatagaacatttccatcatggcaaagagctctattgatagtgttcatccagagtttctgttccaggaccaaactgagggttgggctgctatttctcatggcccaataacaagatgcagatgagctggggaggaagagagtttttatttctgcaaccagttacagggagaaggcctggaaatcatcaccaggccaactcaaaattatgacgttttccagagcttatataccttctaagctatatgtctacgtgtaagtgtgcattcacctgaagacgtaagtgattaacttcttttaatctgtaactaaggtctgagtccggaagatcttcccctggagcctcagtaaatttacttaatctaaatgggtccaggtgctggggtaattacccttatcttgtcccctgctaaatcatggaggtttggggaattccctttagagcaccattaacctgtttgttgaaggcctgggaatttcctccaaacccccattaaacctgtttaatcccaaattggttccgttaaaaattccctccttaatttgtccaattttaaaggcccaaaaaaggctggggcaaactcctgaatggcctttgttacattccaacctttgtttaaaaacaccggtttttaatatttaacttaaccatttaatctctactgaaacacttgttatataaatctgcattaatgagaactggcctgcgccatatctccttctcagaatatcttagggttgtgatcccctgtgtgaagagaatatatctctggagatctcaatctctctaccccaaaaaaaatctcactcggagaaaactcagactcttatctccacagcgctatctctctcctctccgcttgtctaagatggtgctccttgttgctgtgcctgctttcatcctgggatctcccttcaccatcaggattgccttcacctcattccagtcttggatctttcttcttgtttcttgagtattttttttttttttttgctgcattcccttcagtggcctcttgggaaaagatgtgtagggagaaaaattttctttagaaacttgcatatctgacaatatatttatcctatcctgacatttggtagatagttcagctgggtacagaattctaattaattttccttcctgatttataagacattgctccattttcttctggcttccaatattgctgctgagaagtctgacaccattcaaatgcctgattttttccatgtgattgttgttttctgtctggagtgttgtaggattgcctctttatctacagtgttctgaaatttcatgacgtaggtctttcttcattcattatggtagacactcagtgggccatttaatcgggaaaaacatgtgttcttcaagttctacaaactttattacttcctttttcttgtgtctttctctggtctgttttcagccccgagtctcttagatctgtcctctaatattcctattgactttacttcattttctaagtctttatccttttgctttactttccgagagacctgcttaaccttatctcccaactcttttattgaatttcatttcttttactatatattttttactttgaatacacctctctcttcctcacattttcccccatagtattttgtcttcaattgacagttctactatcttattactctggagatattaataatagtttttaaatttttatttatttttattttcaaaacagtgtcttactctgtcactcaggctggagtgcagtggtgtgatcatggatcactgcagccttgatctctgagctcaagctatcctcctgcttcagcctcccaagtagctggaaccacaggcatgtgtcaccatacccagctaatttttttgtttttgaggtggagtctcactctgtagcccggtctggagtgcagtggtgcaatctgggctcacagcaacctctgcctcctgggtcctggttcaagcaattctcctgcctcagcctcctgagtagctgggattacagaaacacactaccatgcccagctaatttttgtatttttgtagagacaggtttcaccatgttgggcagcctgggtctgaactcctgacttgtgatctgcccacttgggctccccaaagtgttgggattacaggcgtgagccactgcacccggccactaatttttaaattgttaataaagacgaggtcttgctatgttgcccagtatggtcttgaactcgtgggcttaagtaatcttctgcctcagcctcccaaagtgttgggattacaggtgtgagccactgaatctgacattttttaaaagttttcttctctttaccaagtcttttttcccctttctgcttttttgggttgttttattttgatctctatcttgctagaaactttctgcagacgtttagtaatactagatttttgagagtgggcaactggaaagctgattggaaactctgaatacatgggtgaggcttgttggctgtgagtgtcattgcttgatgtcctggcaaggccaatgggtttgggacccctactattagtataggcctgattccctgggaaaggctcttttgatctcctgcctggaggataaaggcctggctaccagccttctgtgtgtaatgtgagggagaagggctggagtattcaacatcatgctgaatcctttcaatgatcatcttgtttttagtaatctcctaccttaactctctgtcttctgctagtatgggaaagatgacctgaaaatctaaccatttatttttcccccattaatatcattttatgattattcagaagttaaataattgtcatgctgtcctccaaaaagactgaatcaactagcaacaaataagaattttctcacagctctgccagcattttaaaagaatagctttattgagcccaggaggtcaaggctgcagtgagctgtgattacaccactctaccccagcctgggtgacagagcaaaaccctgtctcaaaaaagaaatttaaggaacagctttattgttgtaaaatagacatacaataaacagagcacatatttaaattgtgcaacttatactttgatataaccctgtgaaaacatcaccacaatcaagatagtgaatatatttatcacctcctgatacagtttagctctgtgtccccacctaagtctcatgttgaattgtaatccccaatgctgggggaggggctttgtgggaggtgattgaattgtgggggtgcacttcccccttgctgttcttgagatagtgaatgagctctcatgagctccccttcactcactctctttcctgctgccatgtgaggatgtgcttgcctcttctttgcccttctgccatgatgtgtttcctgagtcctccctaaccatgcctcctgtacagcttgcagaactgtgagtcagttaaatctcttttcttcataaattacccagtctcaggtggctctttatagcagtgtgaaaaggaactaatatacctcctaagttacctcaagcttcttcttaattccttctcctcccttccttcattgccaagcaaacaaccacctgttttctgtcactatagattagtttacattttgtgggttttttttttttttgagacaaggtctcactctgttgcccaggatggagtgcagtggtgcgatcatagctcattgcagccttgaactcctagtttcaagtggtcctcccacttcagcctcctgagtacctgggactacaggggtacaccaccacaactggcttaaaaaattttttaaataaaaatggggtcttgttatgtttctcaggctggtctcgaactcctcgcctcaagcagccctccctccttggcctcccaaattgttgggattacaggcatgagtcatgactcctggcctagtttacattttctagagttttgtataaatggaaacatacagaatgtatttttttgcggagtgggggagtgtttctatttctttctttcttttttctttttttttttttttttttgagacggagtctcgctctgtctgttgcccaggctggagtgcagtggtgcgatctcggctcaccgcaagctccacctcccgggttcaagcaattctcctgcctcagcctcctgagtagctgggactacaggcgcccgccaccacacctggctaattttttttgtatttttggtagagacggggtttcaccatgttagccaggatggtctcgatctcctgacctcgtgatctgcccgcttcggcctccctaagtgctgggattacaggcgtgagccaccgtgcccggcccaagtgtttctatttcttaaccagctttcatgcaatctttttttattttaccatctctgtgatcccactcccaaaggtactagatgtcgattggtccttaggatcagctaccatttgcccaactgctttccagccttccaaaaatttttttctttttttcttaaagatactcctgtgtgaggctcagaactcttgaattgctactgcaaatatgaactcggtgatgtgaatgccagggaattgcctgattgatcaaagaaatgtatccccttctccctcactcttgctgtcttctcatttgttttccccatccttgtggattcgtgaatttaaatatccctttaatgttataatattttaatggcgtttggcgaaaagtacagaattaggtgcaagagtgcatagctgttattttttttttggcctctgagactgttcatatatgcaagttatttaacagaaagttctgcagtgacctgagatgtcaggggggtctgatagagtacgtttgaaggcagttactggaaaaaaataatgccatttctggtttgtacttcggtaagttcagatgacccaatatattgtttacatgtggcattcagtaaaaaagtagcttcccctccctttcttcttccttttctcctttcctgcttctataaagcatctgctttgggaaacttcttaggaggagagcttgccagcccgtgggtaatggagaggtcttgcagagataaaagagatgctcccactcaatgcaggatggtgtggaggtaaatggggatacgtctggcatcactcaggaatgggccttcctggcagggaagagaagggaggggaaagaggaagggagtcaaagatgaattgctgaatacggggattccagggcctggagccaggaagagaactttgggaggtgtgaacctggagggcatcagctgatgaggagcagcctgaagtccggggaggacctgtttttggtggccaggaagaaagtgccttccacacacagggaggccacaaggctgatgggctgggggttggaaggacagccctaggacaggcttgggaagcaggctcaggtagggactgcgaggttcttgttgagtctttttcattcctggtcttagaaaatagaatccaaggcctcttgagagtggaaggtgggttgggaggagggcagatggggcttaggcccaggacacccgtagagctactgcccagctgtctctcagggactctgctgaggtcactccaaggatcattcttagccttgctagacagtactgacagagggaaccgtagtatcgcacccacttccttctctttcaatgaaagtttaaaggtcaccatttcctctggcaaaggaagttccacaaatattccatttccggtcttagaaacagcaaggtatcaagcaattgcaaacttcctgtgctggggaattcccaaggaagtaggggcagagttctggtggagacaaagtgaattccgagtgattagtcagtagcagtagcagtagcagtagcagtagcagtagcagtagcagtagcagtagcagtagcagtagcagtagcagcagcagaaccagaatttccccgcacgtgtctcaggctctcatttgccaactcagtctctaagtatttttattggcaggaaaaataaaatagctatgagtgaaataattcattagacctgagcctccatcaattttgtgtttaaaggcctgactctctttacctttccctgggatggaagatgcaaatgttcctgatgtcactgtcaaaaaagaagaaccagtgggtatattgtatgcttgagttccagccatttgtcacaatagatagagatgactgccatgtgtgtagactttctatagactgtgtgctaaacccgacctgccacttccaaggagtagatgaggaatgtccatggttctggggagccctaccccaatttggggcagacattccaaagctcattttctgtggagggggttgatggttaaaggacggcctgggagtaactcgtctgtactagggcccaggagagttacatgctgcttcccatgttattcatcattcccccatgtgaatagctatggcgtgaggtccaaggttagggcctttctaccataaatgggggaataaaattcccctaccagcctgagaagtttctgttataaagaggctttttttttgcgggggtgggggagcaagccgactaatgtgttatttccatacggtttgttttaaaatgtagatgtcatatgcaggagaggtggtgtagtgagtcacaacgggattagaaggaccagtccgaaaagcagaagagggtcaagttcagggcactgaggactactgcattcagtggcgtgaaaggcagatggctgaacaggagggggacattacattgcttgttctccttgagcctcgatttcctcatctaaaaagagggtcatttattcacagaacatttattaaacttgtgccaggcaccgtgccaggagctggactaaaaattaaatccacccctgtgagctgctctgaaggctaaaatatgaagtatgtaaaagtaaccaagtgctgtacacatgcagctattcaatgactgtgtgggcattgcggcagattttaattttcttttttatttctttctctttagtgagaggtgttggttgttattattgtcgtcgctgtaactgtctatttcacttgcttttttgttgcctccagcccattccagggctgtcatctaagacacttcttatcacctaaataaccggggaggcaaagcgctttcttaagagatggatccagaagaacaatgctggttttctgtagaaaaaggggctgtgggaagtagagataagaagggaattggccaagatgaatgtacagagccttattttttttttataacacagcaagattagatacaaaacaggacaatagcatcatctgtttttataactggaaaggacctcactttacaggtggggaagaatagagtggagaagtgaagagaatggtcacagagtcaatcagcatgtctgcgtcaaagctgggattcccaattcagggctcttactacagtgacgtatggctaatattttggcattgtttcggggaaaagctgaagccctgatggtgtacgtcactcttgagatagtctgtagtccagcagggaggaaagcaaggaagggaggtggaggcagcatttttgggtgtaacatttcgttcttgttttgtggccaaatcatagtgtgattgggacaagccactgcctttctctgagcctccactttctttttcttcttaagagggagggaatagtagagtaaaagtagtcattttatcaaacacctgctattttggagccatattgcaagtgggttgggggttgaacacttggctttattacccataggattaaatccaacctcgatactgtggcattcccaaactccagtctaatcttcttctccatcagccatgccccacgacaccctggtcatatctgatgttgccccttgcacttgccccctccttatctttgctttctgacctaccatatggctattggttgaaattctcattttccagggccttgcttaaatatcatctcatccattaaaactttcttgaacctccccttgccctgttcctccctaatgtctcaagccagaatttatttccttttgtggccaagggactgggtttgtgacctctctcacgagacttaatattgagaccaaacgtctttagacctcaccagccagagagatgagcatctatggaatgcaggcttttgcctggacttgctgatgcagggcctctgccttcctccagggcctctcctgctgttttaggaatttccctcatggcacagtccatgagctcagggtcaagttcatacatgtttttacttcttctactctgcaaatggtcttcttgaactctgagggtcctaaagctgctctgcagtttgtggggtgagtagaaaggggctttcaaaagttgtgctgttgtttcccaccccaatagcatgaaacacaaagatgcttacaaatagctgccttgctttctagtcccaacttctctctcctgaggctttaaaacaagtcccctaggttgagctggactggagttgtatcctatcttcattatctgtctactctctttctgctctctagagaagatattatatatgtgtgtatgtatgtgtaaatatataatatccatatatagaacatatattgttatatttacatatacatacataacatatgcatgtattcatatatacatatgtagtatcaaagttggaattaaactgtatattttgtaatttgcttttatttgcatctatcactgtaaaatgaatatttatccataccgtaagatattcttcaatgtattttttttttttttgaaacagggtcttgctttgttgcccaggctggagtgcaatgacccgatcttgggtcactgcagccttgacctccccggctcaagtgatcttcccaccttagccctctgagtagctgggactaaaggtgtgtgcctccacacccagctttttaattttttttgtattttttttttaaagacagggttttgccacattgcccaagctggtcttgagctcctgggtccaagcaatcctcccactttggcctcccaaagtgctaagattacaagcatgagccaccacacctggcctcaatgtaatttttaatggctgtatagtattccatcatgtggttgtacccaaaattatttaaccagtccccagtttatttcaatttttttttactattttgaataatgttttagtaaatacccacaaaatatgtacaatggctgggcttagtggctcacccctgtaatcccaacactttgggagtctgaggcaggtgggtcacctgaggtcaggagttcgagaccatcttggttaacatggtgaaaccccgtctctaccaaaaatacaaaaattagccgggtgtggtggcacacacctgtaatcgcagctacttgggaggctgaagtaggaaaatcacttgaacctaggaggcggaggttgcagtgagccgagatcacactactgtactccagcatgggcaacagtgagactccatctcaaaaaaaaaaaaaaaaaaaaaaaagtacaatttgttgtacctccctgattatttcttttaagtagaattttcttataattttttttataagtaaaattttgaatcaagggagaagcacctggagtccttcagatacctattgccaaactgaacttttctgttccaggtttactacattcagcctgactcagggtttggggagtagaggagggggtggaggcagagggcctctccctgtccccacagacctcccttggtgaggtccaagtctggacaggtggagtgtggcattgcaccgtcaggtcctgcttcctgtaattcccctaaatccatccagtggagcctcattgttcaagtcttttttttttttttttttttttaactcccctgaagacggagtctcactctgtcgcccaggctggagtgcagtggcacgatcttgactcatttcaacctctgcctcccaggttcaagtaattctcctgcctcagcctcctgagtagctggcactacaggcgtgtaccatcacgcccggctaatttttttttgtatttttagtagagacggggtttcaccatgttggccaggctggtctcgaactcctaaccttgtgatctacccgcctctgcctcccaaagtgctgggcttacaggtgtgagccaccaggcctggcctcaagtctattttttaactccaggaggcctggtattcagagggattagggctggcagaagggcctcaaagctttcaaggcctggggaataggctgcagcctggttcagggtaacccaagtgattttggttccaaagggacaggaaaaaaagtgattgatatggaagttgtcaaagtgcaactgtcaagacattaaaaaatgtaacccttttactaatatacagtagacttgtgttaaatatttaactgattgtaaaaggaaaaaaccagacgcagttttccctaccatactgtcacaacacctcaacactgagttcttctgtgacctctagtcaccgaaatgcttggggatttctcccaccactagtcctccagcagccgacaccagttgggtgtcctaattcactccaacactatctacctggagttagcgttagatcccacaggttgagggctcagtctcacaagactgcctcccacttcaggtgccagttacaagtggtaggttgtcacctatgcttctgactgatggctataaatctgggtttgcttccctcgggttccgtgaatttgctagagcagctcacagaactcaggaaaacacttaagtttaccagtttattctaaaagatattacaaaggatacagatgaacaccagatgaagagatgcgcagagcaaagcatgtgagaaggggtgtggagcttccatgcccctctggggcaccaccctccaggaaccttcatgtgtccagctatctgggagcccttccaaaccctgtcctttttgggtttttaagagtggctttattacatacacatgattgaccgaaccattggccattggtgactgacacaaccttcagcccctccactccctccagtggttggggagtggggctaacagtctcaagtctccaatcctgccttggtctttcctgtgacaaaccccatcatgaagctactgcattggggctgccagccagcagtcatctattagcatgcaaaagacactcttattattccagagattccaagggtttttaaaagctgtatgtcaggaaacaggagatgaagaacaaatatatatttcacaacatcacactcgttgggggaattgacaggatagcaaaactgattaaaggaggataggagagactgagatatatatttccatatatatatatagagagagagagagatatttccatatatatatatagatctagagagagagagagatagagagagaagagtctttccacacatttgggggagcagttccggaggtacagcccggacaggagatgtgagaagatcgtggttantgttcccctggtccagaacccctccaagtgggcttaagtaggaagggtggtgagcggcaggtaaacacacgtcaaaggcagtcttcctctctgagggaaaacacttgtataagcattgcaatcaatgggcctctttaattatgtgccagtggcaagagcgggtgctgaacccaggggcctgcctcaatccggggcctttgaggcagaataaagtggtctcaggttgttggcatttccttgcccttccacccgaagcagacacaaatcctctctggaggcaagttccccaattcagccagtacaactcccacagactaagatcaatcatgtacaagctcacagacaaaggtcaccaaacacacagagcaataaacaaattcatgagtgacgtgaatgagaataaacagaaacaataaccaccagctgggatgctctaagtcttcagctgttagaattcctgaatatagaataaaactgccacaatggcaaacatgcatctagtacttactgtgtgctgggttctaagaattttgcacattgtgccagataccgactcagcttcacactcaccctcctactgtgccctcttaatttgcactagattaaaaggtagaaaggaagaggcagctattctgttcttggctgtgcctctggcagcacatgcaaaatgggcagtaacagtggcagtcacaggtaagtagccttctcacagtgtggagttaaaggcatgggactgagacgagcaaggttcctaaagggacagtggccagtaaatgaccaggggctactggagtggctgcatggctctgtggaagctcagaggagccttgggtcctgcaggtgcagtagcagctttctgtagttcctgatctctgggtcccacaatcttccccgtttttgctcctccacttctaattttgtaactgacttccctgtgtgtacttctctctctgattgaaatagccagactggtttctgtttcctgataagacattgtctggtacgaacacagtaactcatttaatccgatatctctatgaaggaggtacaataattattcctattttacagatgaggaaacacagcagaaaaataaagtcaattgtctaaggttgcacatttagtcaagggaagggttgatataacatataattatttagaaaacatctaaggaaataaaaggcataatttaaaaataaaactaggcaggtttaaaaaaatgaagtaatctataagtaaaaaagtataattgttgaaatacatatcttagtggatgggttaaatagctgaagaaatgattaatgaactggaaggtagttctgaggaaatcagaattcagcatagatagaaaaaatgggaatttacaaaagtacacaggaattataaaagaggttaaattatagggagggtagaatgagaattaacattggtctaactggaattttggaagaagagaatagagagaatgaacaaggcaatatttaaagaggtggctgagaatttttcagaaccaacacaaactatgactttaccagtagagaaaacaatgtacactgaggaggataaataaatatactatgaacaaattgtaataataatactcaacaaagacaaagagaagatcttaaaatcagcaaaaaaagaaagtcagacttagaaagaaatgacaatggcagactactcaacaacaacaatggaaaccaaattcagtgaaacagtattttcaaaatgcatatttaatctatctttgaagaataagggtgaaaagggtgaaaattgctgccttatacaaaatatcaacattaacaaaaagtaatgaaggtaatataaaaatgttttcaaataaacaaaactgagagagtttaccaccaacaagcattcattaaatggacttttaaatgcagtttttaggaagaaggaaaacaattcctaaggaaggtctgagatgcaaaaaggaattatgaacaaagaaattgttaaaattataggtgaattaaaaaaactgcctgcataaatgataataatgacaatgatgctattaataatgagttgataaggataaagaaaaggacagaattaaaatactagaaaacaagcatgctggaaaggattcaggaattacttgaaggttaaagttctagggtccttctatccttctagaggggagtcaatatattaatttttgaccgtcacttacacagtgaaaaactttaaggataaccataaaaaaatagaaatagagagtataacttctgaaacagtcaagggaaaaatatggaataagaaaactgaccaaaaaacatctcagtcaatcaaaaaaaaaaaaaaaaagaaagaaaaggttcggaaggagaaaatcaaagcatagaaaaagcgggacaaatagaagtggaaaagaaaaaggtagaagaaacaggtccagaaatatcactgatgcactaaatcaccattaaaagatgaaaacaaatgaacaacatcaaaaaattctagtgactgtagtagtgctgatcagaataggctctaagataagatgcattattgtgagtcaacttgtgatgatgaaaggtttaattcaccagaaagacacaattataaacttgtaatcaaatagttttattttatttactttatttatttattttttttgagacaggatcttgttctgttgctcaggctggagtgcagtggcttgatctcagctcactgcagcctccacctcttgaggctcaagctttcttcctgccttagcctcatgagtagctgggtccacaggcacacaccaccaagccctgctaatttttgtattttttgtagagatggggtttcaccatgttaccaggctggtctcaaactcctgggctcaagcgatctgcccccctcggcttcccaaagtgttgggattataggcgtgagccacggtgcctggcctcaaataactatttaagtgaaacaaaactagtatggcactaatgaaaaatgtataaatccataatcgcagagggatttcaacttacttctttcgattatgtaaaggtcaaacagacaaaagacaatgacaaaacttaatgcaatgaacacttttgatttaatgaacatatattggatatgtacccaagaattagagaatacatactagttttgagtttatgcagaacatttacaaaaatttagtggaagcctaaattataaaaagttgctgtcacgtagaataacacacaaacccctgagtccggaattcaaagccctccacactctcctctacctttgcatctttatcctccaccacactgcagtgcatactctgggctactactcactgttcttgattcaaattccatgttctgtcagctcaaatcattctctctgcctggaataactacttcatacatattctgctattgaattcttgtcttagcaccccatctactccaagacgatgtccagttggggttactccctgtcccattttctttgattacactttttttttctacttccattatattattgatcacatctgtgccacagtttttgactttgtgtctgcttttactcttttctagaccctgagagctcctgaagggttgggtcatttcttttttatttgctcattcctcatggcacagtgagtgcttaataaatggctattgactgaaattaaactgtatctaaatggacatattccacttctgggccattcattctttctttctattggaaccaggagatggggaaccataacaaaggtaaggttgtgccatgtgaaagaacatggaaccttcccctgagggccaaaaaagagcagggaaaggtgcaaagacaaaatcttccatttttaaacaatgtaagaatgtggtccacctcatgctcaggtgggactttatcatgacgttatttttggggacttatagctgcatcatttaccccatatacatttacctttagtgtagggaactgaggacaggaattttgttgatgcagactcttgctaatgaggctaacacttggagaatttttatcatgcattcaagaagcttgttttacatttcttcattaatactttagttggtggtttagctttagttgtaggcttatcagatatttggagatatcttcataaacgatggctttggttttagaagagttattctgaagctactatttctggcaataatcaaacagcatggccatttgttttgtaaggcctttcctaaaatatgacggtaaaatctacgtgtggaaaaatgcttattcttctgtcctctataaatgtgaatctagtttgtcttcaaaatgaaatcaagtgattaaaatgtagttttctaagaagataaatggagcaaagcactctgtgtttcacagtgttggaaatcactcatccctcataaaactgtcccaactgatcctgactcacatgaatgaattaaaataagagttaataacatcaatttacatttttaaagacactttcccatgttttagactattggttggaaaagctggtaggtgtacaatttgtggagagttggctgtttttgtctgtcgttgtttgacgtatttcaaagccatatctaattttgttgcagaatggtctgaattctacaaaaatgttgagttgtgtagtgtggagaagtacggagccatttactgaaaggctggggggaaatgacgagaccctgagataaggcagtagtggtgcgaacagagtggaagggaggtagttgagatatgttcagagtagaatcagaatggacatagtgaacaactggatgcaggtgggggctgaggaagcaaagttgaggataattctgagacttctaggttgatccactgaagttacattattcaacaccacaaggaaactaggggaatgagaaggcatactggtttgctttggagtggaagggcagtgatgtaagaggagttaatgagttaaagtttggatatgcctgaacttcaatttgatatgtgcatctgatatacccttggggtgaccctccaggcaatggttgaacatgtgtatttcttagtaactgataggcatcacagactcacatcagtaaggaagcaacagcaaacttgattggacgatatacctggaactcagtaccctatgactggagcaagtctctgtcagtgaaatgaggataagaagaatcttgaccttgtggaatatgttgttaggaatatatgtgatgaacaacataggatacttcctacagggctccacatgtagtaagggctttataaatgcttgataaatattattgttgtaatttatttccaaagtaagatgccactggaggaatctttggaacccaaattaataacaaataggactggatgcaatggctcacacctgtaatcccagcactttggaaggccaaggcaggaggatctcttgagcccagaaattcaagaccagcctgggtgacacagggagaccttgtatctatgaagaattaaaaaaaattaaccagatgtggtggtgcacgcctatagtccctgctgcttgagaggctgaggtgggaggattgcttgagcccatgaggttgaggctgcagtgagccataattgtgccaccacactccagactgggtgacagagtgagaccctatctcaaataaataaataaataaataaataaataagtacaaaccagcaaacactaatcctttctagagattattgaactctggagggcagatctgaatggagccagcagagggacctatggagatcagcctggccctggacagcaccaggcaatggggttgctagagaggtaatggggttgaacagggtttaagccatgaggtctcaagaatccgtgaagactcagactaatttttttttttttgcatgaggattaggtgttcctaggaatttcaatgagagcagggttaatgaaggaatgcagggtaggagagctgagggaaggcatctgagagagcctggcttatgaatggctgcgtcagtatggctcacctgctttccttgtatctacttagcagatgatcccaccccaggcctccagggccaaggtcatttccacatagtcatgggcccttgagggcctggagcagtgtaaggaagacagagtcttaagaaattgcattaacagtcatggtgcttggcaagtgtcgtcatcctatgccaagcctgatctgaaggggtgcatgctcataggtagctgctgcccaagattacagcagcttcttcaatcccagatccatgctctcctatattcatttttccaggggttcctgtccttcgacagtgatgagatgcagaatgacttattgagttattctcctgatagttgccaacttttccaaatgacaatggggcatggagcttgagagtggaaatgaggccctagggatagcgtgcttaggaaaacactcccagcctgatgtaattctgggggtacaatggcattttcatcatcaagactgatgtaaagggtgactagcagtgagttgggggtgactcgcactggggctaggtttctgattctgcctaatccagacagagcagaagcactagtgggctggtagagggcctccagggcctcacttaatgtcctggaaaaacagctccagattgttggttcacgttctgaggacaagcttgggtactacaggatagagagagtggtgggagatgccgtggcctgccctgctgatgcctgccctgccattcctgcgtgtgatgtctctggggcatcttgccttccctgcccagacctgtagttcagctgagggcatgtggaggccaaatggcttcttagagtgttactttccttgaacagctctgctgggagaactggaggagctagctagtcacggtaactgcagcagtcaaaggatcgtcccggtggaggtggggtggaaaggtagagaaagagaacatatagcgttttccttggagatgtgtgggcatgtcatagaggaaatacccaattcctgagccttgagccctccaggaaaccttggaatattaggttagtcatccccaaggaagtctaagaattctggtctcacccatctcctttaattcccacaatgatcctacatgatattaaggaacacgggccagtaaccctccaagcaatggatgtggtggtgaagtttgacctcatgatggagcggaggttggtttgaaacctaagaatttaatttattgtttcaaactgttctccactcagcgttattaaagcatacataattgacacataaaaattgtatatgtctacggtgtacaatgtgatgtttcgatctatgtatacattgtgaaatgattacaacaagctaaataacatacccattcatcgtgtttcaaaggaattaaactcaagcacaaaagagaggtgctgttgaagagtagggctgctctatctaagtagtatgtctggggttgtcctggatcagggtccttttgtgctagtaataaaccagcccttctggggctgctccactttccccacattttcttctggagcctccctaagaattaggacatggccactttctctgcataggcttcctacttcaacaaggacagggcttgtgctgccccatgccacttgagtgtccctacagcacagagctgagtgcacactggctgagtgaggaaatcccccagattaatcttggttctaagcatcatggctgtatttcacacgtatatgaattacaaattacagcatagtcgaataaggatttttgtgctacaactggaatcccagattatgcaaattggatagtataatattgaaattcctaggactttttattagttttaaaaaattatacaagcttagagtaagaaattaaacagtgcaaaagaattcactgtgaaaagtaaaatgctctgtctctgctgagagacagatattgcagcccagatactactggggtcaatagtttcctttaagcatgccattttgatggtttatgggacttacagctcaagaagcttgacactagggttgatctcagaaaatcattgttgcaggtattagatatgaccgtctcataaagatacacacacagacacagcgattggagatattcactggggcttatgggctgcttgtcctttctgctctgtgcctaagttgggctcagagtagcctggcatcggctgtggggagaatgctggcatggggttagcaggagcccacttaacatgtcctaagccacctggaagagtccttcaaggagaccagactccagaggccctaaggaaggaaggacttttgcccgtttttaggtattctagtcccagagtttagggaggaatggtttggctttgggtcgtgtgcccctttaccgagtgggatgggatgtgcccatgagctgttgagctggctcttggagaagacagcaaaagcgggaataagaggtcaggaagctgtgtggttgtaggaaatcccagcagagggcctgggggtcaaaagtggtcatggtagtgacggtggaggctgaggtggtagaaaatcagaggacaaaccccatgggctgctggtgatctgaccgagctcctatgctctcctggttcattttaggctctgtagcagcagatgattggctggtgtgagagcagtgcacctgccatatcaggcaatccaagacaagtccaagctacgctgggaggaaacctgaaggcagcagcaggtagactggctgaagacagacaggcaggcaacttgtcaatcagatttgtgtttttaaggacttttaactggggagccctccatgacagatcagatgagagaggaatctgggtccgcccatgtgtcaagctaccagagggtcccatcggtgcttggatcttctttgaagctgggtctgaggtttgcaggtagagggtgagctggtcagagggacctattgcagagctaaccaacaccttcccaggaatgcaagcacaagcaccccaccgcgggcaggcgggcaggcacttctccttttgccaccaggacctcacagaggctgatctggctctgtgaggtgggaaaatgggttgtacttagtacatagagataaaaggcttaggaggcccctccatcctgtgaccctgtccccagaccacaggtgccggcaggtgctgctatttcaaggctgggcctcagtgcaagcttgtggtttcttgcccacctgtgatgtcctcccactaatgaaggggctctccatcctctgtctgcctctagcaagtggaggctctgggccctgggcaagacacagggggaaatgccatctgttatccaaatatatttcaatgtgacaggaaagctgtctttagagcacagcgcatgtgctctacattgatcccaggagtttgagacaacattgcaagactgggcaacaagcaagactctgtctctacaaaaaataaaaaaaattagttgggcatggtggtacatgcctgtggtcccagctactcctaagttgaagagggagaattgcttgaggccaggagttcaaggctgcagtgagctatgatcacaccactgcactctancctgggtgacagagcaagaccctgtctctaaaataataatcgtaatacattttttttaaagtaaaacaaaaaaaggtcacactttctcataccaaaataaattccaaataaattaaaggcttaaacatgagaaagttaaaccataaaattactagaagaaaataaaagcaaatatttagataatcctggggataaatttctttggaatgaatttccttaagatgaatctctaaaagtgaaattcagggttcaaaggtcttttctttgtccttttcttttccctttccctctccctttttctttctttctctttctttctttctttctttctttctttctttctttctttatctttcttccttccttccttccttccttccttcctttcctgcttgcttgctttctttctttccttccttccttctttctctccctttctttctctttctttctctttctttctttctttctttctttctttctttctttctttctttctttctactttctttcttctctttccttccttccatctttctttctttctttctttcttttctttctctctttctctctctctctctctctttctttttttttctggtgagacagggtctcattctgtcactcagactggagaacagtcgcatgaacatggctcacagcagccttgacctcctgggttcaagcaattctcctgcctcagtctctcaagtagctgagaccacaggcacccaccaccaaacctggctaatttttgtatttttagtagagatggggtttcaccacattggccaggctggtcttgaactcctgacctcaggtgatctgcctgccttggccttctgaagtgctgggattacaggctgggcctctacgcccggccgagactacctctcttttaactggatctctgagctctgggcagagcccaccctgaatcctggtctccaaaaagggaaaattattaggaggctagaccatatgatgcttttacagtgcacttaaaaaaaagtttgttttttttttaaaagacatttctacatgtctaaactacaatcttccttgaaaacccaagagtagcttctgttgcaatagctagtcaaaaatataatagtcaaaaaaatcaggtaacacaacacaaacgcaagcagtttaagagctgaaatgaacttgtctgtttacactctagggattccataaggaaaaatagaagtttctccctaaaagggagcctggcaccttctccattttctttaaggaaccccaggctattataaactattttagggctctcatgcagcagacggtgcaagagaaaggagagacagcagaagtaaatgaagaaaacagaatccagtcaacagagaagaaaaaaacttttgctcaaaaaaaggcaagttcctaggaaagaaaaaaaaaacatgagggctatttaaatacaaagacgcatacatacacatgcacacatcttggatgttagcttttaattaagctgacttttaactattgaggtcctttaaaataaatcttttaaaatcttattacgatatttcagctaggacaaattgctgctatttcagcattaccaagtatcaaaccagaaaaggcttgatttaggaaccaaacccaggctgtcgtggtaggaaaaaaggcagaacgttagctatggaacccacagcatggggcaacagccattgctctttcagtatggcctggctagcaaaaaggtggccttgttatgtaaataaagcccgtttggtggtcaaaatgaaacatcttttcctttttttttttcttttgctggccgttttttcccccaccataccacgtttgtgtgtgtgggagggtgggaatttagccacttcagaggcctcattccccataatttggaaatttcctttggatttgatcaagtcagatagagtaggtcaaacccaatgggaaaaagactgaaacagcaataaaaacagaaacaaacagttaagcaaaatgaatgatcacacaacttatatgattactgagtgctctaatggtaaggagaaattaagaccagctggttgttaaactttagccaagacaaaaccccaattcagctacttacctagggttgggtctcaggctgaagaccgctcactaccgttctagaagcaagaaataaaacttgaactcgtcttacctgtgtagcaggacaagccgcagacaaaatccctcagacaccaaattaaagaaggaagggctttattgggcctggagctgcggcaagactcacgtctccaacaaccgagctccccgagtgtgcaattcctgtcccttttaagggctcacaactctaaggcggtccacatgagagagtcgtgatagattgagcaagcagggggtatgtgactgggggctgcatgcacctgtagttagaatggaacagaacatgacagggatcttcacagtgcttttcttatgcaaataaccgattagatcaggggtcgatctttaccaggcccagggtgtgtcaccgggctgtctgcttgtggatttcatttctgccttttagttattacttctttctttggaggcagaaattgggcataagacaatatgaggggtggtctcctctcttacctgcggggagtgagctcaaactccttaaaggagttacctgccttccatcatcagggaagcaggaaatcttgccttccttgttggaagcaagtaaaactcaaaacaaacaaagaaaaaaacagggagttgtacagcaaaataaacttttgattttgaccaaattttgggagatcaggaattctctgaaggagatgctttcagacctcagcaaattgtcctgttggtttgagccataaagttagctcatgctggtaccaaacaccagtaggagatttgtcaaaggtaagaggcatctccactcagaatcccttcgtggttaccaacatgtgaaccttggaaatctgagacaggtctcagttaatttagaaagtttattttgccacggttgaggacacccacccatgacagagcatcaggaggtcctgaccacatgtgctcagggtggtctgagcacagcttggttttacacattttagggagacatgagacatcagtgaatatatgtaagatgtacactggttccctccagaaaggcagaacaacttgaagcagggagggagcttccaggtcacaggtaggtgagagacaaacaattgcattcttctgagtgtctgattagcctttccaaaggaggcaatcagatatgcatttatcacagtgagcagaggggtgactttgaatagaatgggaggcaggtttgccctaagcagttcccagcttgacttttccctttagcttagtgatttggaggccccaagatttattttccttctacatcactgtgggcagctgactaggaaagctttgtaggactggtgggcagtgtgagagcccagtggggggtggtggtcctgtgccaatggtagcaaccacctgtgaggctgagtaaactcatttcccaacctcctctagcagccccagtggagatacagatgaagcagactagcgatacaacccagcctgaagttttgtctggtgagtgtaatggaataaaaatgggaagggtgctgaagagaccagcaagaaaatggttgaagagatggggcacagaaattaagctggatcaaaaaggacggaaaagcagaaagggccgatagagagaggggatatctatgggttcgcgattctgaaaaggacaaatcactggtgctttgagaagagagagggtgagaaagcaggaaggctggaggctgtcatccaagaggcggacatctgtgaacatgattccaagagtcaccagaccatgggggtggccaaagggagtgcctcttctcacctcctactcttaattccttgtactcaagataataagttcccagaagagaagtacccatatttaattcatctgtgtcttcctagcagtactaaaaatattatatgaaaggtatcaaacctttgagaatgtgtgctgctaaattgttaaggatgctggaaaactcaagacgtccctgatcctgagcctgagtatgagcctgtggtgagcccaatgcaggtctccattcagacaaaggcctcagggaacggatgagacctagggacagagatgcatgctggagcagcattccccatccctactgcagctcaggccagctgactgctttatgagtaaacgttaccagggaacactttgcagtcttaacacacatgcccacctgtgaccactgatccctgttgggtgaccactgacatcagagattcgatggcagcaatgaagacaaggctatcctcattaggaaggaaaggaaggaggagggaggagggcaaacgaatctttcctgcttgtcaaccacgtccatctctgttaggtgatttcccatgtgtgactttgtttatctttataataactctgagaggtaggtcttgatgtccacattttgaacatgaggacatccagccaggaagttgagttctggggacatagctgagagggcaaagctacatataaacccctctttgttttttctggcttatccactgagtgccccctgcaatccaccagcccatttgtgaagtgcatactataggtaagttggcacaggaggagtggatgtgggcgattttgtcacagctctccaggaacttacacactggtgaggagggccaggtatgttcctgaccagtcacaatcaaagcaacctcctactaatcagggaggcttggtacctggggaatgctatgttgaaaggttcttttctgggttttaaaatgatgggtctatttccttattcttaagattgctttttttctggctagaacttaaaagaaattttcagtaaaatttcccttccctggcacaaagtgagcttgaaatgaattcccaggtggccttgatactttaaaatattgcctcctataaaatcaacctttagaagaaggaagtcaaagaacatgctagatttcacaaaggttaattccttgaaatccagttatctacaggacaatgttgtcaaagaaaaaattatttggccaggcacggcggctcatgcctataatcccagcactttgggaggctgaggcaggtggatcacctgaggtcaggagttcgagaccagcctggccaacatggtgaaaccccatctctactaaaaatacaaaaaaaattagccaggtgtggtggtgggcacctgtaatcccagctacacgggaggctgaggcaggagaatcgcttgaacccgggaggaggaagttgcagtgagccaagttcaagccactgcaccccagcctgggcaacagagcaagactttgtctccaaaaaaaaaaaaaattcaatgatatttttaaattcatggtaaggaagatttcattcagaaccagcacagaagatataggaaacactgcaatgggactttgcggtgggggagagagattgaacacaactacatatacagcacgggcaaggacatattcatagccaggaagcagagcaaagatcagtggatgcgaaattactaagaggaaacatgaaaaataagggagcttctgcctaaacccacctaaccggatccttgctgaagacaggacagggtgattggacaccactttggggatggtggaggatggggaatccagtgagatttcaagggtgatcagatattgaacatagaaggttcttgctaaaaaaggagtttacaagaaagtgtacaaatgtgcctgggagaaggttcaggagcctgactaaaatttggtcaagcagagaatatttgccaagataatagctaagtcttctgacaaacaatagatgctaagccagcaagggtgatgtgctcagagaaagcactgagggcttatttccttttcccccaatctccactcagtcaagtctagtccccttgtcaatgtagccatttgtaagaatgcaatcaggcagggtcccatctcctagtgacaggactgactgaagttctgctgaagagagtggcctggggctgacaccgagatttcagagtcctgggtttcgccgagagctcagtgtagtgccatgccctctctccacctgaacgcccagtgtgggcaggaacaactgcagctagaagtctggcacttacgctggggtctaagacctgcctgatctgctaactagtcttgtcccttggctataaactgacgttggcacctggccagaaagatgagcaagagatctctgacacacctttaagtccctgtggagtaggattatgttggggaaggtcattctcttgactgagcagcaatttcagaaggaagtcccatgccgaagtgagagaaggcagggaatcctgcctagtcagctagagcaaaacagtctgcaggacgggacccagggatgtgatcctcccatccaaaggcactgaactaaatgactaaaatactttccagggctcacgttctttgaagaatggggactaaaactaagacaggagccagcaagtgaggacttggaaggagatggctcatctgatcagcctccactcaacaattttaatcatccacactggcatggggacacaatatgaataagttgacagggacctactctgattaagcagtgggctagtgcagagacctgtcagtcaagagtggacaggagatgatttcagacagtgagaacaaaattaacagagtcatgtgctaaagggtggctggaactacagaggagtttaagactcaagaggtctggctgggcgcggtggctcatgcctgtaatcccagcactttgggaggccgaggcgggcggatcacaaggtgaggagatcaagaccatcctggctaacgcagtgaaaccccatctctactaaaaatacaaaatattagccaggcgtggtggcgggcacctgtagtcccagctactcgggaggctgaggcaagagaatggcgtgaacccgggaggcagagcttgcagtgagccaagattgcgccactgccctccagcctgggcgacagagcgagactccgtctcaaaaaaaaaaaaaagacttgagggagttgtttatttttgttttctttttaagacagggtctttgttgggcgcggtagctcacgcctgtagtcccagcactttggaaggctgaggtggaaagatctcttgagcccaggagtttgaggccactctgggcaacatagcaagacaccgtctctacaaaaaatgtgcaggttgaggctgcagtgagcagaaaaacaccgctgcactctagcctggatgacagagcgagaccctgtctcggaaaaaaaaagaaaaaagacagggtctcgctgtgtcacacaggctggaatgcaatggtgcaatcatggttcactacagcctggaactcctgagctcaagcaattctcctaccttggcctaccaaagttctaggactacaggtgtgagccaccacacgtggcctcaggagagatcttaataataaaaggacaaattgccttgcatcccttaggggcaggattgacacatccaaggatcaggcagaaagcctgtgcggagtgggatgagcaaagagaaaggctgagagttgtgaagagggagatgcagtgccagctaggacaggcctttttgggctatgggaggttttcagaggagaccccacctaaactaacccataacattgcagtggggacctgttgaagtcatggactactacctgaaagccagagaaatgggaggagcctttcctctgaggagggactctagtccataggtatcttgccaccaaatacatggacaggccctgggggaagatggtggtagcccagctggaggaaaaccatttgccacctgaactagcccagggtaagccacccaggcactgagggtgcacacccatgcatgcacacacagaatcacactccttcctattattcctcaattcaggggtctcaacacccattttttttgtttttggggttttttttacatgtttacattttatttatttattattttgtgacagggtcccactctgttgcccaggctggagcacagtgcagtcgtgcaatcatattagattggtgcaaaagtaatcacggtttttgtcattaaaagttttgccattacttttaatgataaaaaccacgattacttttgacgcaacttaaaagctcactgcagcctcaaaattcctggtctcagggaatcctcctgcctcagcttcctgaatagctgggactacaggcacatgcaatcctacctggctaattttttaaaaattttttttgtaaagatagaaactcattttgttgtccaggctggtttcaaactcttgtctttgtgcctccctctgccctgtgcaagaccttctggatgcccactaatgaagacttccagggagaggaaaagtaaacataggtccctgatcaagggaccagggtttatcgaccacaaacagcatgcccagattccactggcagtcctagaggtcgcatttgccccaagtgtgtgtggaaggcctctccctagcagttggtttatacaccagccacagcacagcatattctcttaaattgtgaacatttgcaaaaactccttgaggacaactatcatgtcttgtgtacttttgttttgtttcccttcccctatgtacacgcgcgcgcatgcactcatgcacgcacgcgcgcgcgcacacacacacacacacccctcaaactgaatgcctggtgtgctgaatggatgaatggctaatgtaagtcattctaaaagctactttctttggcataccatcacctttgatttcatctttctggaactcctatgttcccagatgaatttggaaagccctcaggaaacatttcaaaattgctatatgggagaaatgggagggtctctctagaaatttacctgccacaggtatttctggtaagacacagcaaaggtggcaccacccattcctcgttacaatgtcaatgccagtcaccttcctgtcccataaaactttattaaaggtgcagaattcccatggaagcaggtggacaccatctgcttccagccagccaggggagcaaggtgtccactgtgcctttgtggcaggaactgcgcttctctactctcccactttgaggcctctggggctggcctgctgcctcctcattgacaaggctgcttactgagcagttcattctgagctggacatagtgcttctggtgagtctctacttctatttaacccaaagatattctttcctaaggaaacgctttcctgtcgggggaggttagctccagatggaagtcacaagtgatggcatggtagctctcatccgtttgggtggatgatattcacggagcaccaccatgagccagtcatggaggtgaacagtatatgccagccctgaatcaggtgcattgacagcaagggagacaagcaaacaaagctgaggtttgctgaggatgttcaagactcacacagcacagaggagcatccaccacccagcttgggaaaggacttgttatagagggggtgaagcatgagctgagtcttgaaagactagaaattagccaaactacaaggaggagaaggagtttccagtcaggaagaacaggttatgcaaaagcacagagactagaaagaatatcacattcaaggaactgcaaatagacaggaaagattgatgcgtgggataggagaggagggcaggggattccaggtgggccctgcttgccacactcaggagcttgaacttatccacaaaggaggtgtggaaccagtaatgaatgggttttgtgcaagggcttcatgtcaccagatttgctttttggagatacttctgtggctgatatgtgaggaagggatggaggaagtttccgtggcaatcaggaaaaccaattagcagatgattcaaatggcctaggggaaaagggaggaggacttggactaccatgcagcagcagaaatggagagaaataacagatcccaggcactcaggaagcgctcagaatgagcccttcaaagaacttatggtaggtgatggatggatggagtgtgagtcctgggatagcattgcctgggaaaatactttctagttgagacagggaagtgggccagcagaaatggagggcttcttctttttgctttaaatacttttataatatttggaactttgaaaatgagcagatatattagcaaaaagcctaaaagggatatttttgaaatcactgctagttctaacatataactttcagcttgcacacatcatcaattaactttgatagcgcctttctgaaactatcatcccaaatagcaatccttgtaaaaacctattttgaaaaacgggccttgtaggatagcctcacagatgttttgtggtagattttctaacattctaatgtcagggagtgaaaggaatcccgttagaagttggaaaattctggaatctctattcatggtattaaagttttgccgtcacacaaaagtttaacacctttacacaatcagacttcctcattttacattgctcggtaattagaggaaatcagtcacccagagcctgggtcctagacttgacaaaatgcacccaacaaatcctgagtggccttgctgaggacttctcccagaagatagaaaactcagttccagccaacaagggggaagcagctgaagaagtgaaattaacaaagtcctggaaggaaatgaccaaatcatctttgattgtgtaataaccagagagtagaatacagctacgacagacattttgggagagaagcattttatcatagcttttagaagagaatatttttcagcatcataagcacacaattccaagacagatactttcaagggattgttttgacgatgttnnggttttgggaccccattcaaacttcatgttgaattttaatcttcaatgttgagcgaggtcctgtgggagggtgattggatcatgggggtgggttctcccttgctgttctcaatgatagtgagtgagttctcacaagacctggttatttgaaagtgtgtagcacctctccccttcattctctcactcgtcactgctccgccatagtaagatgtgtgtgtttcccctttgccttccgccatgattgtaagtttcctgaagcctcccagctatgcttcctgtacagcctgtagaactgtgaatcagttagacctcttttcttcataaattacccagtctcaggtcattctttatagcagtgtgagagtggatgaatatagtgccatatgtttgtattcccagctacccaggaggctgaggtaagaggattgcttgagcctgggagtttaaggctgcagtgagccatgactgtaccactgctctccagcctgggtgacagcgagaccttgtttccaaaaaaaaaaaacccaaactgtgtaaaatgtgttcataaaagtgtcttgctcccacacctgtccctatatatcttattcctcagcctccgacaactactttattcatttcttatgtatcttccagaatcaaaaaaaaaaaatcaaatacaagcacagtggaatgtattgcccttcttcccctcccttttgttacatcagagttagcatatcataaatacggtctgcattttcttctttttcagctatcagcatgttttggagaggatttcatattcgtgcagacagcatgtattagtcagtccttgcattgctataaggaaatacctgagactgcataatttataaagaaaagaggtttaattggctcacagcttcgcaggctgttccacaggaagcatggcagcatctgcttctggggaggccttaggaagcttttactcatgcagaagacaaagcgggagtggatgtcttatatggcaggagcaggactgagagagagagagagagagagaaaggatgccacatacttttaaacaaccagatcttgtgggaactctgtcacgagaacagcaccaaagggatagtgctaaaccattcataagaactccacccccatgatccaatcaccccacaccaggccccacctccaacatcggggattacaatttgacatgagatttgggctgggacacagaaccaaacaataccagagtgctttctcattcttttctatagctgcctagtattctatgtcctttacttcatttaggcagtctcttgttgatagacacttgggttacttccaatttttcctattacaaatgatgtgcaatgaataattttgatcattttccatttcacatgggttatgtccatctgtgggataaatctccaggagtgaaattgctggatcaaaggggaagtgcacttgtgattttcatagttagcaaattttgttctataagggtcatatcaatttatagtcccacgcgtaatatttaacagtggggatttcccgacagtttgaccaacaaggtctgttgttaaacttttgatttttgtcaatctgatgggaaaatactagtatctcaaagtgcttttaatttgactttcttattacaatgttaagcatcattttactctgcccaagatcaaatagtattttcttttctgtgaacagactgttaagatcccttgcctcttgttttgctggatttttgttcttttttttcaaatgttttgaggcagttctttacatgtgaaacaagttatctctttatctggggtgtgagttacaactacttttcctctggcttgttttgcgctttgactttgcttctggtgattcccgcaattctgaaagtgtactttttgcatcattcattcttatacacccatgctcttgttcacgctggttcctctacctgagggctttttcttttcttttctatctgggaacattttttagagacagggtctcactctgtcatccacgctggagtgcaatggtgcgatcacagctcactgcagtcttgaacttctgggctcaagcaatcctccagtgtcagcttcccaagtagctaggactacaggtgcatgccagcatgcctggctgattgttttatttatttatttattttttgtagagatgggagtctcactatgttgcccaggctggtcttgaactcctgggctcaagcgatctttctgcccctgccacccaaagtgctgggattacaggcgtaagccaccatgcccagcccatgtgtggaaatcttctgtttatccctttaggcttgattcttatgtcgttctcctccctccttcctggctactcctcttgttctttatcttactctacttgtcatgttaccttgtttctgcttataactagctgcctctcctatctgaggagggacttgtgactgttctcatctctgtactcccaggtcctagtacatagcgcttgctcaacagatgtttggtgcattgatagataaatcaatggtagctgttaataccagtcctgactccctgcagtgcttcagctgatcctgttccagatgtgcactgaatatctttctgttgaacaacagaaataaaggggatgggtgaggaggatagtcttcggtggccaaggatatttgtaggtactttgcagcactcagcaatgaggagtgggctttagtcccccaagaactctcacagccctgtttgtctttactgttcagtgtcaaatccaagacaagtcaatgatcaggaaagacctttttttttcttcagtgaagtttatttcagaaccattgaacagtatgatatttgctcatttataaatattcccatttaaataatctgagcttatatattttcagtcttaattaaaggacttgatttaaagagagcacaccagtccaaattgaattgattccatagctattaaaaactaggctcttttacagacactgctacttcttgccccctttgaataaattagaccaatgaataaaacaaacaaacaaataaataaataaatagggaagcggttgctcatcagaatgtgggagcgaatgacagagggtttcttagaaccaaatgtggccgtggtttctgtcaggcgggctttaagtgagtaggagaggtgagagaggcctggctcaacaaaagggctggggattggccctgaaaggagagagctgactgtcctggctgatggacaggagatcctcttagcactaccctaaggcaggcagttgggcattggtgtagacaacaggaaagtccaggctatagccgtactcaaaaacctttctgttccctttctgccagccctagggattgagtccacattcagcacaggactctctgggtacagctctctttaggaagacacaaattgcatggtgaagtcagttatatcctggccgcctttggtccctcccaggaagacgggcatgttttctgcttgagaggtgctgatgtaccagttggggaactgggcagactcaaattccagcttgttattgatttctatcttgttgaagacaaatcgcttttccatcttcttctttgggtaatttttgggatctacactctgcagcgaaagagaaagaagaatttttgtggggcaagggacaaaaatgctatgggaaagatgttctttgggttggccagaaaggaaactgacgagcaggtcacatgatcaggagccacactcctgagttgtaactgggcccccaactttctgtgtgattattaaaagagcccttcttcttttctaaaacttagtgccaaatgctgaggagcataatgtaggtgagaattttttttttttgggggggtgaaaattaagctagagcttcttgaagtacctagtttccaggggctttttattgtatttttccttatggtcctagaatgacatcaacttggaaatgaagcttttgctgagaaagctggaggtgatagtggtggtgattttgggagtggagtggacgtgataatgggaccctttaagtcatctatttcccaaggtgtctatcaaatgagagcagccctaacaatatataatctgttggggttgtaactatggtaggacataataacatcggcaaaatgatttaattttctgcagcaggattgaaggttgcacgcagttaaaaattatgttaaatttatttacattaatgcaaaattgtcaaatagacctgttcccagcttttcctagggatgggggcggggagaaggtggttgtctgggaataagtggtagcaggaggctgagaagggcttcattccatagcattcacttacctccagctgtagagtgggcttatcatctttcaacacgcaggacaggtacagattcttttccttgaggcccaaggccacaggtattttgtcattactttcttctccttgtacaaaggacatggagaacaccactgaagaaagaagggggtcttgtggttagggacacagcagtgcagggtcaccccaacccctaggccccatgagtaggatacatgtaatttggtagcctctgtgggaacccacagtgaggttccttggcctaagacacaggataacttgacttctcacagacaatagcagggtcattttgttgatttagggtttcccctcaaaggcctgagggtttctcagagcctcatagcagtaggaacggagaatgaaagagggtctacattttaaatgctgaaggaaggaaggaaggaagccattgtgtcactggctggcaatgtgcccatccacaggagcggaacaacttgatcaatgtggaaggaaaggaaagaggtgaggctgtacttctgccagaaatcaggcaccagaactgtttcaggaacagagagtagcccatgggaagaaactgggagaggagaggctgagctgggaaagtggctccaaagagagacactcattttgatcttcctcagtcacagcagtgtcaattggaaggccctgggatcactcttactacccgattccaaagaaacaggattttcttggcctggctgagagcaaatagcttcccccttgagtgaggctgtccttcaaagtcagcagccttagttgcccacactcctgtgcagaggctttggctactgtggcacgatgccaggcagatcaccacagctaatgatgggttcaccgcacttgaaacttttgcccgttacagcggagagatataagttcctgctgggcggtaaaatttccctacaaggaaccacctggcattgggtgggacggatgttggggcaaggggggaagactggggagggggatggacacattatcgctccagcactcttgtttcagcctcaacaacaggaagagagaacccacaggcagttaggccatgtccatcaaatgaccccatattgtggaagaattgacattgcactatgcccaagagacttgggtggacatggtcctgggagtgcttgagccgtctaatttctcagggtcacactcctgttaacaaatgcactggccagtgcaatcaaatgtgccatttctaggaccaaagtttgtatattcctttttaatattttttttcacttgtgttgatcatttgccttaaattaactttctactttgtttaaaacatggagaattagcaagctgccaggaagccaggcagggaaaccaggatgtttccatttaccttgttgctccatatcctgtccctggaggtggagagctttcagttcatatggaccagacatcaccaagcttttttgctgtgagtcccggagcgtgcagttcagtgatcgtacaggtgcatcgtgcacataagcctcgttatcccatgtgtcgaagaagataggttctgaaatgtggagcacatgttgtttaggtataaaatcagaagggcaggcctcgtgaggcaaggtggcaaaatttgatttcttggaggacacctgagcatatacggtcaaagtctgatgacaacaccagtagggatgaagctgggagtggggtggctaagaacactggacctgacactattagacatgggttccagcttcaggtctattactgctcactgtggccgagcaacagagctacttaggtaaaatggtgatggtcataacactagcccacagggaggttacgaacctctggtgacaatgtaagtgaaaggcccctgagaaagagtgagggagttgcaaatgtcagtagccatcaagatcttctttaagaatagtttccactaaagagatgattgctttggtttccagccttctttgttttgtctccccgctgggccttctacctttaaagggctttggctctgggggaattgagttggctggggcttgatgacttccaagaggacacaagtggagatctactgcctgctcttggctaactaccttcttcaaagatgaagggaaagaaggtgctcaggtcattctcctggaaggtctgtgggcagggaaccagcatcttcctcagcttgtccatggccacaacaactgacgcggcctgcctgaagcccttgctgtagtggtggtcggagattcgtagctggatgccgccatccagagggcagaggtccaggtcctggaaggagcactgcggagagagcgagggagggagcctggtgaggtggtcctgccaggaaccatgctttgacatcagagagtagaaagctcagagaggaggaaagggcttgaaagaatcccgagcttctaaagatcatccctctctgggccaggcgtggtggctcatgcctgtaatcccagcactttgggaagccgaggtggatgaatcatttaggtcaggacttcaaaaccagcctggccaacatggcgaaaccccttctctactaaaaatacaaaaattagctgggtgtggtggggtgcacctgtaatcctagctattcaggagactgaggaaggagaatcgcttgaactcaggaggtggaggatgcagtaagccaagattgtaccactgcactccagcctgggcaacagagtgagactctgtctcataaaacaaaacaaaacaaaacaaaacaaaataaaataaaataaaataaaaagattatccctctctgaagctcaaggaggttaagggtgtactcaagggcacacagcaggttagaggcagactcaagactagaatgtgggctttctgacaccttacaggctattcttttagaataaatcccatttctactttgttcatcttttttgtacatgccccacctacaccatacatgtataccttctctatatctttttgtatccctaatgctgtcacactatgatttgctttttcatgcagatgaccataacattttccattcacctatgctcactcagcaagtattcaatttttctacactgttcttttttttcctttttcataacactgtctcataggcattctgcaaatcctgtgagagtactttttgtgaaatgttaccactttcctcttattcagagaagctccgtattaaggcttcactgaggttgccttaaggcatgataatggttcaaaggcttgaaagacagttaaagagacctgtaagtgcacaaaagaaagttgagcaggagagaatttcttgcctggagcagagccaagctactggaagaggcaatgggggcaaaggccaggcagacaagccaatgggctcctcccacagctgcagccaacaagttatgccagtcttaaaacttctaaagaaatatgtttttaacaagattgaggactggattatgaggctaggggaggctatcacaaactggaataaaataaagccagagaaaagtggctgccttccaacctgcacaactgacctagctaggctgatggctgggccacctaggaaggctactgagcatcatataaaacagaagggacagcaggaatataacatggctctttgtaaggatgagtctgaaaaatgaccatttgctgcccaaatgcccttagctacaactgaaaatatttcagaactggaggttgcaggatgctggaatctcagagatcatccagctcagccctttatttttcagatgaggtccaaagcgggtaaaatgacttgtcaaggtcaaacagcaagtgaatggttttctttcaagtctcaattcatctttttgtttatatcatctatgtcttgttgttataagcttcaccccaggtagcaaaaaactattctactcaaaaggggtagacatatgttagttctcaagatcatctcttggtttcagagtttaactcaagtgattggcataggctgaatccatctcttaaaaggataatcaaatttatgttgaagacttggttgtcttcctactatgaaatgggaaacattatcactactcctcccctgtcaccaccaagtgtggccaccaccaccaacgttagtgagtgactgtggtgatatgatgaccaagtggccaggtcagcaagtggtgcagcctgtgtctcactggaagaggttaaagtctttctaaaacaaaataccatggcatcaaagtggcccagaactcccttctttgagctttccctgtgttagagcccttccttgggttgggagttaaacccatagtcttaccttcatctgtttagggccatcagcttcaaagaacaagtcatcctcattgccactgtaataaaaacagggacatgtctcaattatgtcttctaaacaggtttatttttccttccctgtgtacaagacttgactgttcataagaaactgcaaacagcctgcctctcaaagctgcctgaaacacctggcaagtttcacagtgatatgcgcagaacagtccagaaggcagattctaggcctggcaggtgggcaccctgggtgctccctgttggatcttgaggcctaacctctagcccagcagagtcagctaaaatctgagctctccctctccctccaagccacactttgcaaagggattccttgtattgtgggcttggaatcttttctccccatttgcctctgcaggaagcccttgcaacaacacatctggatagcctccaggtcccaaggctggagggacttgtaatgggaaagtagtctttaaatcagatttacttggcaccctgtttgccactgaaagaggcaatttaggggaaaaatctggtctccaagcacagataacactctactcttgaaagaggagacctgctcatgttactggtctcagcgtctccactgacctgtaataagccatcatttcactggcgagctcaggtacttctgccatggctgcttcagacacctgtgtaaaaaggagaaaatgagtgacttccccatgacggctacgttcatgtgtgatttctctcagcatccagtgcatggcagtcatgcaaagaaatgatctctgagtaaatgaatgaatgtgtgaaagagaagtcctttgggtctagagaaaagcatttgctaaaccaaaccccaactagcaatgtattggctaggagagctggagcagaggctttgacactaacctttagggtgtcagctgttagataagcagtatccattcccagaatatttcccgagtcataagcattatattacacctggcatttttgcaaaaagctgagagagggaggcagagagggaaggagagggagagacagagaaagaaagagagagagagagagaatatgcatacacacaaagaggcagagagacagagagactcccttagcacctagttgtaaggaagattaaagtcatacttgagcaatgaagattggctgaagagaatcccagagcagcctgttgtgccttgtgcctcgaagaggtttggtatctgccagtttctccctcgctgtttttatagctttcaaaagcagaagtaggaggctgagaaatttctctgttgaatacctgatttcacaatcaagttaaaggaaaggggaaaagagtattggtggaagcttcttaggggaggggactaataaactgagataattctctggttcatggaagggcaaggagtagcaaactatgacacattttgcaaatgtatcaccatgcaaatatgcattgttttcctgacaatcgttgtgcagttgatgtccacattaaaatactggattttcccacgttagaagaatgtttaaatttagtatatgtgggacaaagtggaagacacacagatttatacatgcacatacttttcttcattcacttctttgtacttaagtttaggaatcttcccacttacagatggataaatgggtacaatgaagggccaatagccctccctgtctgtattgagggtgtgggtctctaccttgggtgctgttctctgcctcgggagctctctgtcaattgcaggagcctctgaggagaaaattgacctttcttggctggggcagagaacatacggtatgcagggttcaggctcctgacggagttggggcaaccctggagataagctcacacaaccctgcaagaccaggtgctgttaccctagccaatctcatggatgaaccagatcaatgccagatgagctctgcctaaaatgattttttggtgaactctgaaaagtggaatattgtttctgtaagaatatccatctgagactctatctcttggtaataccaagagttatcagtttctctttaaccgagacaccagcaaagtgcctgctccagggtactgcccaggggagccctccatttgtagaatgaatgagagtccaggttatgaacagtgcctggagtgtaggaacaccctcctttgcctctttgacaggtctgcatcataacactttttttttttttttgagacagagtctcactctgtcgcccaggctggagtgcagtggcacgatctcggccccctgcaagttccgcctcccgggttcacaccattctcctgcctcagcctccccagcagctgggactacaggcacctgccgccacgcccggctaattttttgtatttttagtagagacagggtttcaccatgttagccaggatggtctcgatctcctgaccttgtgatctgcccgcctcggcctcccaaagtgttgggattacaggcgtgagccaccgtgtccagcctgtaacacttcttatagcactgagttgaaaccttgctcctcctggttcctccaggaaactgaaatctttttgagccaagtctagcacagtgcctggcatgtacattcaggtggtagagtttgctgcttgaatgggtgaatgggaatttgacagcatttttattcaaattagtatgtgccaggtatcgtgctcgctctgcattatccaagggagtgagcctctgtgcaagtatttgagacacgagggaaataggttctactgtgggaaaaagagcatttcatggacttgctctccaagcagccttctgatttttaatttggctcccagtatcttgatatcaggagtcagtcacaagaactccatctttagtaagttatattttccacaggaaatctaaaagctgttcaacatgttagtttcctgtgaatttgataagccataatccattcctaacactgagccctcctgaaatttggtgtctggtcctgcagatagctaaaagccctgtctgggtggcctaggggactcctctgttttgcctccacaggatccactttgcaaattaaccactggttctcccgttgtaggaactgccaccttcctcagagcctgtctttcttccttccttccttccttcctctttctttttctttctctctctctttctttcttttcttttctttctttctttctttctttctttctttctttctttctttctttctttcttcctttctttctctttctctctttctctctttctctttctttctttctctctccctccctccctctctctctttctttctttttctttcttttctcttttctttctctctttctttctccctccctctctctctttttctttgtctctccctcccttctctctctctttctctttctctctctctctctcctagacaggatctacctttatcccccaggctggagtgcagtggtacaatcatgcattcattgcatgatcacagcagcctcaaacccttcctcagagtctttatgcggcaaccagcagggtctggagggttggtggctctgtgaactctcctgacagaacacagagatgtctttggtctgttgatgtgattacaagctgaacgaaggaggatcaaagccagtgacaggaagggagatatgcaagggacccgagcatcagctctgagttagtccattctgcttctgggacttgggatacaggtcagaaaccttgagcttctacttctccatcttccaattgtagcatccaggacctcagaatctgccagctaagaggagccctaatgattgtctggtgggatatggtgggaccacagagatgaagacatgaatagctatttgaatgtgaacagcagacgaagaaatcaaggctaggagggtggaagtgactcatccaatagcacagtgtggttgaagcagcactagtatccaggttgcatgagcccctgatgctttcgctcgagggaaattttggagccatggggcaatgccccctgacgtaacagtctccacagttctgccatgtctcatcctggccctgtaacctggacccaaatctgctaccatcccatccatctcaggaagtgaaacctcttatgtcaaataggttgtgcaacgtatgtatcagatcctgtcttcccaaggagaccgctcaggccacagcacttccttccgatccccaatgagcagaaaatatctcgctataaacatagttggcactaagggagggagtggaagagtgatgatgatgtagatggtgatgtagccccaaggaagtggaacaagcagagatggggagctggaaatgccaggatgctccagcttttggggaattattcagctcttgagtcactaaagcctttctcagctgcaagttcctctttaccctgtcaggtcattcttccaagacaggagactgacatttattcaaagcagcaagtgccctgataccatcttgtgtctaatcatgggcttcgcagccagttatcaaggttgatctcatctcattggtcttcaatcattttgaacaagaagacaagcaaaataatcatgggttagttcttatattattgtgtgtacatgcagtgatgtctgttctttgtagtgagctgttccttccttgttcaccctcttgcttagaacagaactaagcaatctgcccccaacattttccccaatttcccatctcattcttggcactggcttcctaatatttgttcttatgagtcattttcttgtatcatttccatgagtccctctgggatcttaaagtatgaaaaatgttgtgtgtacccacacctgtctttgtggatatttctctcctttcccttctgcttctgggattatttgggaatgggcactatgatttttatcatatcgcttccacttcctttatggcatcatctccaatgggcttcttctccctcttggatccaggttctcagattggggacatgcagagtccaaggaacattccattctcctccctggtctagaacaaggagggcttagatatatgagcaggtggctggggctggcgagctatgtagtctccaatggcttttccctgatgtcggagttgttatgtcagttctgggagaccaataagaccttgtccttcctttggatccatcagaaaaagcccctgggtgggtaagatggatggcagggctctcctactctatgtcttttctcacacctagtgggtataagagaggggaccacaaacagagggggctctggtaccacttatccagggtctggaaacattttctgtaaagggccagataataaatgtttcaggtacaactactcaaccttgcatcatttcagaaaagcagtcagataatacataaatgaatgggtgtggctggacttgtcctgcggtcccctgtcttatatcattgtattatatcattttttcttacatacaaatttagaagcaatacttaaaaaaaaaaagccgtcctttattgagcacctactaagtgccaggtacctttttttccctcattatcttattaactcttcataataacctttaaagtagataatattgaaccatttgacctatgcagaaactgaggttgagacaataaattatttaagaccgcacaaacagtaaatgctggaactacgactcaaatatgggttaactgaaccaaaaccagatctttatttctcacttttaattgttacatatgtttattgcctcatctcctgtccacatggtgcccatcggcagactcctttctcattctcagtgattgagtgacattctaaactacattggcctggcagattcacctctgtcccctaaatgtttccacattgtccttttaggattgagatcctctctgttcccttgtcttccctcctttcttcttctggcggtgacgtgctgtgtgaatttgtttctttctcctctcagggtagtactgggactttccaaatcagggtttttaatgatctctcttcncttttctgaatttcttccttattcccattcactttctcatctataagtggcanctttgttgctggaagatatcccttgtgcagggattnctctttaanaatttgtcnnnaccgtgatcgtcaacctcccaccctgtagggcctcaagcattgaggacaatcactggctgcccattaacccagaaatgttgccgagacaggaggccgtggcccaagttcctggaatggggtattattatgtcagcacaaaggcctttgcacaaatgaaggctttaaaaatgcagtcctagtcaggtggaggagggcttataggattcccaggaatctggatcattctcttgagagctttcccttgtctctgttaaaactcacatcgtacggcccaaataacaacaaaaaatggatgtaaattcttgaaataacttgtggatgggggaacaaggcccaccccccagatctgccagaagcttcaggtgagggtcccaaatgccaaaaagtctggtatcagagaggatggccagtgacntggggacacatgccctttgctgtgtcactcaaggagcagcagcttcggccccgcacagtgaccaggaccctggcttcccacgctgggcaggagctggtgtctgatgaagggaatgcctggcagcacgtgctgtctgtctcctcgtgtcagcttacctggctttgctgcgaagaggccacttgcatttctttattttttatatttttttaattttttaaattttttattttatttttatttttatttatttatttatttttaatttttttttaattttttaaattatgctttaagttttagggtacatgtgcacattgtgcaggttagttacatacgcatacatgcgccatgctggtgcgctgcacccactaactcgtcatctagcattaggtatatctcccaggttaatccctccccccctccccccaccccacaacagtccccagaatgtgatgttccccttcctgtgtccatgtgatctcattgaatttctttaaaggtggaatctctcagtggggtctaatctgttcagaaatatcaaaagagtatccttgggaatgactggaattccagagtcatctggtaatcctcataaaacaactcctggatgtctctcagcacatctcccaccttgaacgcaggaggctggttcaaatggaggagcatcgctctactgcacttttttttttttttggcctaaagtgcaaaaggggatacgtttcatgtaaataaatcaactgcaaatcgctagttatgctgagccctgtcccgtgctgtggacacaaaggaaccaaaggcttttctccccgcccaacacacacataacacacacacaaaatcataaaaacatacatacccccaacacataacaacacacaacacacacacaaaatatatacacacaacacacaccaaacatgcccacaaacctgtgtccaaaaataaatcctactggtgggtttgtggtctccctaacttcaaaaatgaagccgtggaccttcgcagtgagtgttacagctcttaaagatggcatggatccaaagagtgagcagtagcaacgtttactgtgaagagcaaaaggacaaagcttccacaacccagaaggggaccccagcagggttgctggttggggtggccagcttttacttccttttggcccctcccatgttctgtttccatcctatcagagtgcccttttttcaatcctccctgtgattggctacttttagaatcctgctgattggtgcattttacagagtgctgattggtgcgttttacaatccccttgtaagacagaaaagttcctgattggtgtgttttacaatcctcttgtaagacagaaaagttccccaagtccccactggacccaggaagtccacctggcctcacctttcaactccataatggcatgaaaatacatatgttgtacaaaacatacatacacaaagtatacatgcatctccccaaatatacacataccacagaaacatacacacaggaactcagctacctgtcaaaagtctgcatggtgattgcctctgcagtgagtagttagaaaagtgaatttgtttttcaataaattggagtccttaaaaatcgttgtaagatagaaaatttttaaaagtatataaaataaaatatgtatgtcctttggtctagcatttacacatgtaggaatttatcctagtggagtaatcaatgatatatgcaaagatttggacaagcatattaagcacagaattatgtatgcatatgtgtgtgtatatatatatatatctcatacatataataatgtaaaagtgaaaataactcagatgttcaaaattgaggattagttagactatgatctgtccatatgtgacatacaagttagctgccccttattctctcgagcttcaacctcctataaacagtgtcccttgtatatcagtattggtacagataatcgaacttattgaggttttacatggggcaataaaggcaagagtttatgaatactccatactacactaggtagcaccccctattaaagacaaactcttctctctcatttcccttcctttccggaaccacttggttgaatctctacaagtctctattgcaactgcctcaacatggcaccctccctgcatctccatcttccctgtcctgagagcaatggcctgctgcccccacactcacatcctcattcattccagaagtgagcaccacagaagtgcctacagttaccccaaccaccttcttagaagataagttagtgtttgttttgactttttaaaatttttacttcctcttttccttcacaatctcatcccatcccaagaggtttatcaagaagttctctaaagatatgtgtctccttatggaatttaacagaaatcagggatttgtattctagccatcaagggaataacatttttccaggtctttagacaaataatggaataccttgcagtaattagatacactattgtagaaaagtattgatgaaatggaacgatgtttgagatatcatattgagtagaaaaggcaagatacattaagtaggaaatgtatcttacaaaataatttgtcagacacactcctatatttgtatgttatataaatgcgtatgtgaagaaaggctagaggatgagaccacagtcttcggtgaagtttaagagatgaggctgcagcatgctcagaaaggcctgggttatagttcttccagtaattaaggatgtgatcttgggtaaattgtccatcctctctaaactgcaccaccttttgtctgtaaaacaggaaggatggtatttacccccagggtcatcaaaggatttggttggagaaaaataaataaatgggctgagcccagacctggcacagtgagagcacagtggttgactattgtgctggcctgttgttcctgtgttattgacatgctgctggtggtggtccagaagctattaccttaattggttatgtggatttcccctcatactgagcagctgtgtgtggtgttgtaaaacatagccatacacagtaactgacaagggcaaatgtgatggaaaaatgcaaggaagtgcagataaatagctaatgggctgtagaaggaagctagtccttggagggcttgatcaaggaaggtccttttgcatgtcacctttgaagaagaggggacatagaagaggtatagtgcatcccggagtgtacctggaagggaacatgaaaagaggacatttttctctgggacatggggactccacttgcatgaactctggaattggggcaaagaaccatcatgagaacaagggcttccttgaacctcccaggctcattggctgatctaaaccctgtgtcccctctttccttcactctcctctgttttctatacctgtattattggactggactggaagccacctgatctatcacaagtaccttgaaatgtgttgaataggtgtggcacagtccttagcagagtggcactacccccacaggaatttgtttatacctttggcatggaaaatagcaggaaatgagtgatcactgataactgaggatgctatttattattggccaaaggaatacttgtgttgtatttgcataaccactcacaaactgttgattacaaatgagtaccagacctagctccttcaagtaaaggatcctgagaactgaaggcaaacagagctccaggagtccaagacagagccacagaccacgaggatccctggcccaggtaggtggtcctcctgcactggctttcaaggccaacaggatggatggggaagtagagtagcatctggccatctagacccttgctttttatccccactggaagcacatctgaatttctaaatatgatctctgagacctgcccagaacaccttgctctcagccccagtagcagcctgctctctcccaggagggcttccactaacaagtagggcattgctggagggccaggcagacactagcttaggaaatccaccaaccctggaaatgctagtcccttctctgaaggctcagaagactgactttagagtctagaaaatattggtccttgggaacagattttgagtgcaaagagatggacttcagatggccagatgcactgcttctttagggaattctgtgaaagctccctgcatttatcttaatacaggcagcagatttcatgagtacccccgagggatggccccaggtcctccagcctgtgagcatccttctgtccttcagcagcaccacagtatctttatatgtctttggatacctacgtttctgccagacatctcttgctctgatgttctggctgccaaattctctgtcaagcgcctccaattttttgtgtcctttgatttaccccaacatgacaaaggcagttgtgcttcatgtattcagggatactgccaaaccacaaacaggttaaaatcaaatagcagatatccctgttcctaaagacccatcagctctacccacctgctcctgctcaccgtccttattgttgagtcctgaagcccttccttgtcatttttattttttgcatgaacaatttagttccctttgtctcactcctaaacctttctcaaaggattggatttgtacacaaactgcctatctctgcaatcttagaagtgatatgattctgaacaaatcacttaacttttgattttttattggtaagatgggaataccaatttttgctccacttctgtcctatgttggcctgggctgatgttgaaagctctcggtcaactgagatagggtgtgcagaatttatatatataaatatatctcctccaacccctcccaatgaagcaagtcacgtgagtcaatcctaccctaagatattagggattgagcctcctgggacatttggtggcttaggttttcatgaaaagaggttgcagagcaactgctttttgttaggcaaagattaggctactgcagagactcagcaaacttctatagaaggtgtcagatggtaagtattttaggctttgcttgccagatgatctctcaactagttaaccatgctattgtagcctcgaagcagccagagacaatatgtaaacaagagcatggctgtgtttcaataaaactttatttaaaaaaacagtcagggaccggatttggccaaaggccatagtgtgccagccccaagactagagcaatgcacttttaacttttttattttatttttgtaaaatgccaagatccacaaaaatgctattgcaccccgtgtgttagcactgtgactcaaggtttgggaaattctgctttgaaggcgtgatagacaggagagcatggtctggccccttggtgcctttctggttgcagcgagcatttcaaactacagagcaaggccagtggtctgttcagcactagagacatgcagcaaggtgtcctggggtgagaagatgccataactggtcccctttctatctccttaggtcttggacttcattccattttctgttgagtaataaactcaacgttgaaaatgtcctttgtgggggagaactcaggagtgaaaatgggctctgaggactgggaaaaagatgaaccccagtgctgcttagaaggtaaggttcttgtagaaatctacctcagggccaaagtgtaattcctagagcagaactttgctaggtgctgtgcacagacccagttgtttcctgctgacttgcacagtaagtgagctttcaaatttccctggacaaataactagacaagagaaattctggaagagaaaaggaagctttgcttcagtgtccaggcacatcaggtagtagataaaaggatcgtcctcacctacagatttggggctttagcatcctgtttgccaactggatggttgcatatgcttcaaaatgcacctcttccctcccaacattcccaagtggaagagaagcctccgatgagaaggaactctctaaggctgggctgaacaaatgacccaggcacagggcatctgagtattccatgaggaacacatttgggtgttgcccatgggggacaataggaggaggcttttgacccaaatgattgtctactgaggtgtgacgggagaggcctgtgacatgccagaggccaaacccgtgatccagttcatctctattctatgtttctgaagagggaagctatgatttaatgtcattactatcatgctgctctagtatttctcagcacatacacagaagagggaattaaatggtccttgatacccctaaatccttggaaaatccgaattgcatatgctaacctcactgcgtctgactgcagacccggctgtaagccccctggaaccaggcccaagcctccccgccatgaattttgttcacacaagtaaggcctcggggtgaggtgatgggggtggctgaggtgcgagggtggggatgggggatggagccattgggtcctcttacagggtgagagaattgtagaatggggacacctaagggtgctggatggggctgaagtctttcctttgtggaagcaaatcccattaggagataactctgggaaagatgagcccggggaggggcaggtgatgctcacctgctaagaggcaaagggcaaggaagagtttgtgcctgggaaccttccaggtgcctcttctgaccatagccaagagactggagacacagacctcctcccagcactgaggacaaacagccatggggccagtgggggtgcagggacacccacaccactaagggctcagggcggcgccttcagagcctgaaccttcctctcatgctgccatttgaacaccacaacaccctaataggaaactgttaacattgccactgttcaggtgtggaaaccgagacagacagtggagattccctgccctaggtgacacaggtaataagtgacagatgtggaaatttaaaggtactataacgtctgtctgcctgactcaggcttaaggctcccatcacctcctcttctcaggacagagtcaggaggcctcagcctgagccccagctctagtgcaggttcatgtgggaatactgagcctcactagtacaatggcagagaggaccaaatgggaccaggtgtgtaagggtgcctggcacagttgggggaggctgctgtcgcttctccaccgctgctgctgcagttacctttgatgttttagttttgttgtagttacaccattgctggctttggatctgcactgtgtccactccaggtggaaccacgcacacaagcctctctgtcgggcctgtcctgacttctccttgtcagggctgggatctccttcaaatctggcggaagtggttctccaagtctggtcctcaaacgtcagcagcatcagcgcctagaagtgttaggaatacacattcccaggccccaccacagacctcctgcctcagaaactcagggcgctgaggctctaggggctgctttaacaagccttccaggttatcgtgacgcaccttgaaagtctgagagctactgccctacagaaagttactagtgccctaaagctggcgctggcactgatgttactgctgctgttggagtacaacttccctatagaaaacaactgccagcaccttaagaccactcacaccttcagagtggccttgagaaagatttggggtcaaggatcatgagcgagaacaccacttaagaggatagtgaactagtctgcatgtgagacgctgagatcctatgtcaggctgtgataggagggaaacagaaaccaaaggaaagaacagctttaagaagcgcttaagaggtacaaagtaaaatgatggtgctagaaaagtagcttcttaaaaagagcattttccagtctcaccctggactaactgaatgagaatctcaggagtgtgaggcccaggtatccatggtcttaaaatgccacccaccaggtgattcccagtgtgcaccaggggtgagagtcacagccttaggccatgccactcaaagggtgtcttcagaccagcagcacccacagctctgggagtgcatcagaaagacagaggcttggcaccacccacacctactgaaccatagtttgcaggtgatttcttgcacattaaagtgtgggaaatggaaaagcttagagttcagctagctcggtgactctcagtcaacctgcacctgctccatgaactcagactgcctgggatgggcccagaaaagctcctgaggagattctgatgtaaggcagggctgataaccatggatctcatctgaccccatatcactggggagttacttaggatcttgcctggggccagtcatctcttccatagacactgagagtgtccacgatgcttggggcactacagggtgggaggtggaggatcacgggtgagtcagataggaagcctgctcctggggagcttacagtgctatagggcagcaagccaaggatgccaatacctgtgtgcaggtaccactgacgagtgcagagcgctgcagcaccagagaggaagctaccctgtgcagagggggctgaggagggctgcagggagatgacaggaaagccggtgttacaggaggagtcctccccactctttgggcatgaggagaccaggaggacattctacagtgagaaacccaggcagaggccatgtgcttatggcatgggaaaagaatgacaccttagacttattctctacattagaattgcctaccacagatacccatattatagcttcacatagtgtggtggttactgtgttttcatattgtcacatttgccattttccagccacccacccattcttgacagtcactggcccagcctgggggcccctgttctttatcaaacaagtgcctgagctctttgcagaggtgagggtcacctgtccaatcagaggccaggagggaacgttcccttttaagaccctactctaggcaggcctggcccaaatgagttgctaggagcccacgccctaagaaccctctgagcactgttgtggctggtcctgctgctagaagttgttcctccagggccaggtgcaagatttgtggcttttcaaaggagccactaaagctccagctcagccttgcacggtgctgggctcctgggggcttcctgcctccaaccctcccaactcttccatcaccgctcccttagcctggccagtgcagggatctgttccactctaggcactgctgagggaatgatgcctccagtcagagggtgcaaaaaagagagttaagaaaaacaatgattataaaaagtcctttttatacgccagacattttctttgctcaggctaagtgctacttatttgagtaagcattttagttctcataactcctctctcaagtaggtgctgctattactttcatttcacagatgaggacattgaggtttggagagacttagtaacttgtcctctgtcctacagcagagctgggatttgaatctatctgtccaaatctggaacccatttgcttgcacagaaagcttaattgcttgtcccagcaagatagaaagcctgggagtggaagaaatattcagtggctgtgatgtctgagcccacaggcagggtggagagctagggctggggcccttggacgtggggaagaaagggctgagtcttccattttcaatgtgaagtgttgatatctggtgatattgatctaggtccaaaggtgaagaacttaaacccgaagaaattcagcattcatgaccaggatcacaaagtactggtcctggactctgggaatctcatagcagttccagataaaaactacatacgcccaggtgactctcagttttggctgtgttttctgcctccacctagcaggggtaaggcctcctgctaggtgggctcaactccatgctataccatgccccatctccagcaggtggtggaagcgaggaggagaggccccagggactagggcatcagatgaagggtctctagcaatgaccagatctgaaagtagtctttctggaagggctggagaaaaagaaggaggcagacacttagactggaagaagaggaggcttaaaccggtgtgatggagggagaagtggaccacagagtcaagggagagggactgtgcatcaggcctgaaaccccagcagacaggagagacctttccctgctctcagaacccacacatgttctgactgtctttttccagagatcttctttgcattagcctcatccttgagctcagcctctgcggagaaaggaagtccgattctcctgggggtctctaaaggggagttttgtctctactgtgacaaggataaaggacaaagtcatccatcccttcagctgaaggtgagagttctagctcagtttcctgggcctttggctaccccaaagtaaaaggccaagatcctcaatgcctctcgctttcctgcaaattcttatcttggccaatataacagggacatccacctttctggaagcaccaggcagaagagccccataacttcttctctggttccttgccccttctagggaaggaggagagactcctcacagcggggagacagcaaggagctgagcacctgttctcctctcctgggctcactggtcctggccctgggcgggtggcggtcccctcctgctgtggccctccatgtggcaagcaacacaattgggccaggaccctggcgtgctgctgtagggtaggagggtgtgagggagcactcggagggcagtgtgtctgccctgcaaatttagtcctggatggagcatcctttcacttgaggggagaaatcttaggaagctgaattagatacagatctaagccatattctctaattttaaaaactatagagctgagattttggtatccatctgactcttacgtctctctctctctctctctctctctcagtttatttttaatctgggggacaagaaggcctggaaaagagggcatgattgcttatcatcccttaaataccagtaccaaggctgacacgtcatctttcccaaggaccatctgccttctctcttttcctcctctcctgtgtaaaggcctggaggatgagcacatgtgctgtgttttcctccctctcaaagcctgtgctatctaattaatcccttttacctcacagaaggagaaactgatgaagctggctgcccaaaaggaatcagcacgccggcccttcatcttttatagggctcaggtgggctcctggaacatgctggagtcggcggctcaccccggatggttcatctgcacctcctgcaattgtaatgagcctgttggggtgacagataaatttgagaacaggaaacacattgaattttcatttcaaccagtttgcaaagctgaaatgagccccagtgaggtcagcgattaggaaactgccccattgaacgccttcctcgctaatttgaactaattgtataaaaacaccaaacctgctcactaaactttctgtcattgggtttcatttctcattcatgctttaaggatttgtgtttttaggatatagcaagaagcttgtttaattacaaagttctgggttggaaagagaccggcttctgcttgtgtactgctaccctgaaccatcagacatgcatgtgtgtgtcatatgctatgatgtggccagtctgagtgcaatacttgcagcgggaaggagcagctgggtgcatgctgtgctctagaattagtctttcctactggggtttggtagattctgagggcattgatcctggggcagaagtggctgagtctgtgtctagggtacagtgtgcaagaaagaaatgtaacagcaagtcacaatccagccaagtgatagtggaaaaggggtagttaggtcccagataaggagcagggtgacttgacctgtgggaaaggcacagagacaaggaatctgggtcagatgacagccaggagaccaggtgagggaggagccaggtactgtctgggaggcttgtcaacaagggcatggtcctatcactaagcagggctcagatcctcataatgggggagtggaaggctggccgaacagaaatcagggcctggaaacagagtgagggggtggagacaggagactgaggcttggaaattagtttattagttttagctcttcagttacaagcaataataatagcttctagcttatttaagcaacaagtatactacaaaaggagctttctagaaggatattgggtatattcatttcttactgctgctgtaacaaattaccaccaacttagtggtttaaacaatgcaatgtattatcttgcagttatggaggtcagtctggaatgtgtctcactgggccaaaatcaaagtatcagcaggatagcattgctttgggaggctctaggggagagtcaatttccttgccttttccagcttccagaggccacctgcattccttggctagtggcccactcccatcttcgctgcttgggtttttctcacactgctttgctctgaccctcctgccttcctctttcacatataagaacgcttgcaatttacatcgggctcacgtcaatatccaggatactctcccgtctcaaagaggcttaactttaatcacagatgcaaagtcccttttgctatgtcatgtaacatatacacagggtctggggattagaatgtggacattttcggggtgccattattctgcctatcatgtgaagtaactttcaaaatggaaagacatgctgaagaaaaagtcagggatttctggcaggccagaaatgacagaaggcagaaaacgttggtcccatcactcagatgggtaagagccaatcatgctttttgtcagttagcaaaagattgagattccaagcaaagcatgcaactgccctagtttgggtcatgtgtcgactccttggtcagtgaagggcagcacaccttgatcaatactccctccaagactgtatccaacgaggccagtgatgttcctcaaagcagagctagagagctaatcccaggagagaggcgtgtgggtggtgggcaggaagacaaagctcagccgtaaaggagtagtagggacagcaccctaggcatggaggctcaagtgagatgatacccatgggaaaagctctgataaggtcagctccttctgtttctgatcctgatggtgatggtgatcaacaccagcccagtgacaaaaaagtacatagtatatttagtagatgtttcccacacagagaaatggtaaatattcaaggcgaggaatactccaaacatcctaccttgatcattacacattccgtgcatgtaatgagtacttgcatgtatgccataaatatgtgaaatattatgtatcactatataaaagaaaaaaaaatgtggccaggtgacatccatattttggagaggaaggcatgtcttcttcataatatcacaaaactattttcacaacaaagacacagctgttcaaattagtctctgagccggggctgtctcatggcagtgaggactctggttcccttacagactagcagaaaggagatggggcttactgaccatggccttgaggaggctgaacatgcaggccaaatggagacacagacagcctgggcttggtcctgctccatccccttccaacctgatgagatatagtgagtcactatgacgtgggtcactcatgcttcctgtgaggctccaccaagacagcaagtgcatcaacaccttacggaagcacaaggccctgtttgttgttgacttcatgaaaggcatggttgtggtgatcgcattgagtaggcttttgggtgagaggtgaaaaaccccaactatcatgcattgcagccctctggtggaaactgtgcttcaggctctaaatttcaggctctagactgactccaggatgagtatttggaagctgaagtcaatctgtggtctcttctcctgtagagcaggagtcagcacttttcatagagtgccagattctatatatcctgccacatgctctgttgttacagaacaaagaaggccatagacagcatggctgtgttggcaaatacacaaaacaggcaataagctgtatttggcctttaggctgcagtttgccaacccctgcactaacacagagcttaaaggtggtggtggtgtgctggagctagcttatatcagcttgcaatagccaattgctaacatctcttccaaactctgtgtctgtgccttgatgttgatagtttgaaattggctaccccatttaatgctgcaatcttttctcaccccagcactactgactcccctttgccctgtcttatttttctcactctaacatgctgtatagttttcttcttacatttattgtttgtgtcttccactagcatgtatgtcccacaagttctttgctctgtgatgtatcccaagaacccactgcagtgcttggcacttgtaggaactccataagatttttataaatgaagaaaggaagaaaaaagagagggagggaaaaaggaaaggaagccttctatttaaatgatggccttctccatatttctatagtaatatgacttcccttgcaaagggggatgcattttggaaaatgtgtataaataaactcaggtggttttgaatttcattttcctaactgtaattgtaatcattggtctttatgtttagtgaaaaagttttggcccttatgcctcacacctgagaatcccaaagtattggtttgttagagctcccatagagaaccataaactgggtggcttaaaacaacagaaatgtatcgtctcctggttcaggaggccaaagtctgaactccaggtgttggttcattctgagagctctgagagagaatctgttccaggcttcccttcagtttgtggtagctccagggttccttggctggtggcagcaaaactccagtctctgcccccatcttcacatgactgtcttctctctgtgtttctgtgtccagattgtcctataaggacagagtcatactgaattagggctcactcgaatgacttcatcttaagttgaactgtatctgtaaagaccttatttccaagtaaggtcacattcacagctactgggggataggacctcaacatatctttttgggggacataattcaactcataatacccaacatgataactgttcatcccatgaaatttaatgtctctcaaaaggtgatctcagggcatttaatctgtgacagaaactcccataggaaacattccaaccagaagctcctttcacagctggtcactcctcctaccccatccgaggtcctggggcagggtgaggcaggtggggacaagaagaaggctgtctcgggtgtagaaagagaagacccttattcacccggcactctgttcatgaatgagctatccagcataggatataataaatcgctttaggagtggtagactccaaacatttttttggtcccagttatcctaatcaattaaacaaactctagaacccatcttgaagtgcaggcattgggacattatgaaacttacacagaattcaaaaatttacaagggctaaataaaacagggtctgacatctaatattttcttcccacattcccatgcactgtctggctcaaccatccccaaccctcactctcatcctggtggacacatgcctagtgatgtgatcagctggttcacagggggctggtgatggtggatatacagcttttgccaatttccatggcataactactccaaatatggccaatttcaaactaccaacatgaaggcacagacacagagtttggaagagatgttagcaattggctattgcaagctgatataagctagctccagcacagcaccaccgctacctttaagctccttgtgttagtgcaagggttggcaaactgcagcctaaaggccaaatacagcttactgcctgttttgtgtatttgccaacacagccatgctgtctatggccttctttgttctgtaacaacagagcatgtggcaggatatatagaatctggcagtctttaataagtgctgactcctgctctacaggagaacacagattgtcttcagcttccaaacattcatctctgagtcagtctagagcctgaaatttagactgaagcacagtttccaccagagggctgcaatgcatgatagttggggttttcacctctcacccaaaagcctactcaattttttactgcaaaaacatgttatcatcattattttttacttagcccacctttccttggcaattttccataggaaaatgcattctaaatttcaactaatcaggggacttggagcctctggacacccccttgttccttgcccacagtcccttgcagaaggtgccttatcagagcggctccatgcaggggctcaggacaggatcagatgtcagttgcaccaagggggcagggacagatcctctctgctgaccatgcagaagggactgttcagtgcaccgtcatggtcctggtgatttctggtccataagggaattttcacatgcatcgggtgattgtcacatcagcacaacactgtgaggaaggcagagtgagaatttgtgtgcccattttataggtgagaaaacagatgcagagacattaagtaacttcaccacagtcatgcgggttttaagtggcagactttcaggtgttgtgactcctagtccagagttctttgcactgcccctgaggtgctaaaactctactgtgctttaagactcacttggggagcttcctaaaaagagagattgcacaacctgagattcttgtttaactgttttgggatgtagctcagggatctagctgccttaaaaaaaaaaactcccaagtaattctgatgcaagcggttcttttttgtccacctttgaagaaacactgcctcctccccatacatttcattagaaaatggtaacatgtttttcagcctgagagccatttctgggtgaccggacgtcggcagcccgctgtactagctttcagtctaggcttaaacacacatgataggagatgtcctactccagatgatatgagtctgaaccatggaaaaattccattgtgtggcacatctggtgggtgtgcactgtccccagcagtgaggcacccagtgaagacagcagctgggagaggcttagttacatgcagtgggacagtgtgggctagactgctgagccctctgcagtttactctgtgtcaggcaatgagggtgaaaggctgatcagacccacgtgcagaccataccctccagggagacagatatcagtcaggacaaccccaagtgtagctggagaagcagtgcccaggtatgaccggatgtgtatccaaccaggaaatctgcatataaatataagaggagaaaatgaacagatgttgctcttatatgtagatatttatgaagagcatataattttgttttgtgtgttttaagaagtttataagtatgccttaaaaatgtatagtatatactgtaggtattttttccattagatattttgtttttcatacttatccacattgacattgtagcaacagtataatataacaacctcctctacaaaagcagaaggaagtgaagctttggaaggaagcacccagtgagcttgcccctttcaggtgggtgcagtgagcaggagtcagtgaggttgagatcctttgagaggaggcaatcattaaccaggaaatctgcactgcatcctggccacacctaacccttggacaatggtgcttggagcgccttccagctcttaaggcttgcgatttctttctctcactcttcacccacgatgattaaatcttctcctacagagttggacaataaagccttgagttcctgcctcccctggtgtgatcacgaggcatagacatggccaggaacatgtaggtgtctttgaaagctgaacaagttagtaaatttcaaacctcatttcacccaccagtaaaatgggaataataataaacctattttacatagggttgacaagaggagtaaagagggattcaatgaaagttcgttattatcatttgtagtagcagtgttgataatatcaactgaaagttcattatcattattagtagcagtattgataaccctcttttctgtgccttctcactggtgggcccaggccatcagcaatgcccagggtgtcatggatctctgctgcatcgggcaccagctgtgtcaatggtgagaacagtacaagggtgggcagggcaaggcaggaagcacccaggagcagcagcttcatggggtgaagatgtcaggagcttagggacagtcagagcgggtgtgcctcctcttgtggagcctttctgcgtgggtaggaactgctgcagctgtggccatggattcacctgaatatgggtggaattaggcattcagctgggttagctgtgcctagaaggaggaactctaaactgagaacttgtccctattgccacctctgataggcagatgatccatccatcagtggctgagctgaggtgtgcatggggatgggtaagagcccacacacagggctgatgactgagtctatttagaacaatagatgtaaaatctgataatgtaaaatgtgatagattattttgtcaattagaaatggtaccatataattatatatatacataaacatgtatacatatacacacatatacatgtgtgtataaacacacacagtattgtcccctactcattccataaacctgatgcctttagctgggattcccagctttcactctcctctctgtcatctgctgtctatatcctccccatcctgtaattctggcttatatgccacttcctccctaaagccctccctcaatcccttgctggaagtgacattttcctctttgagctgcccctgcttgtgctttggtgaggtcagctgtattgcagtaccttgtattgtggttgtcacatcatcgtatagaattaatttctgacacattccgtatttttcaaagggcctagtgtggggctttaacagtaactacgccaccacgcccagttaattttttgtatttttggtggagacaaggtttcaccatgttggccgggctggtttcgaactcctgacttcaggtgatctgtctgcctcagcctcctggagtgctaggattgcaggcatgagccactgcacccagccacctatcaaaattttaagtgccatttttattttttattttttgtagaaatggacaagctgatcgcaaaattcacatggaattgcaggaggttccaaatagccaaaacaatcttgaaaaagaagaacaaagttggaggatttacactttccagtttcaagacttagctcttagctacaaagctacagtaatcagaacactatggtcctggcataagtgatgctggacaggtgagccccaaagtgggacttaacctgtgaaggttcttggccttgcccaggaaggaattcaagggcaagccaatgggacaagaaaacagctttattgaaggggcagtattacagctccagccctgttacagctccagccctgttacaactctgactactcctgcacagaagggctaccctgtaggcagagagtagcaactcagggcagttttgcagtcatttatatccacttttaacacatgcagattaagggacaatttatgcagaaatttctacggaattggtaataacttttgggtcatggagtcatcatggaaggggggcggggaactccctggtgttgccatgatgacggtaaactgatatggcgaactggtgggtatgtcacatgaaaagctccttccaccccagccctgtttcaattagtcctcggtttggtccagtgtccaagtcctgcctccagagtcaagtcccaccccctacctcttaaggagagatgtaaatacatggaatagaattgagagtccagaaataatctcatacatctatgatcaattgattttcagcaaaggtgccaagaccattcaatgagggaaagaatcatatttttttcaacaaatggtgctggataaccacatgtgaaagaatgcaactgggcccttatctcacaccatatacagaaattaactcaaaatggctcaaacacttacatgtaagagctaaaactataatattcttagaagaaaacagggatatatctttatgaccttggatttgctggctgattcttaaatgacactgaaagcacaagcaacaaaagaaaaaaaaataggtaaattggacctcatcaaaatttaaaacttttatgctgggtgcacacctgtaatcccagcactttgggaggctgaggcaggaggatctcttgagcccaagaagctgaggctacagtgagccgaaattgtgccactgcactccagcctgggtgacagagcaagaccctgtctcgaataaataaataaacaaatatataattatagatctctggatcttgccttcggagactgactcaactaactggtctgggtgggagcccagccatttgtattttttgaaaactctccaaatgattttactgtgcagccaaggttgagaatcactgtatcatagggttggactcctaactggaaacagtttgcaccatcaggtgtcgcagcattctgataatagttaagctttcctcctagattttctgatattagatgagtcatgtttacaagtttttaccaagagacaaactatctttctgcccttactttctctcttatactattctaatcccagaaccctttggaacttccactgagagatgaatctagaaagtgactctcttggctacaacagagagtaatgttggcctgtttgtgccagatccagttggtgctggtggtgggacagcacctccctgaaatcccctcctctcccgtcagattcagtcccccatttgcatcacgtacaatcatcactatgggtttctattaccttgctagggcatttggaggtaccatatataccaactattagttttgagccatggttcccaaagtgtggactgtagggcacctcagcacactcacgaggtgtcatgggatatttaaatattctgaagaaaacacagtgacatctgtcaggcccgtgaaaaccgttggcattaaattgtctcaacccaattgcttaagaagcagaactggccaggcacggtggctcacatctgtaatcccagcactttgggaggccgaggcgggcagatcacgaggtcaggagttcgagaccagcctgaccaacatagtgaaaccccgtctctactaaaaatataaaaattagccatgcatggtggcatgcacctgtaaccccagctactcaggaggctgaggcaggagaattgcttgaacctgggaagcggaggttgtagtgagccaaaatcgtgccactgcactccagcttgggtgatagtgagactacatctcaaaaaaaaaaaaatgagagagagagagagaagcagaaccatcaggtgtttcttttggcttaaagtactctgtgaagaaattcctgggacacgaaggataccatgaactgagagattttgggaacctctgctttagaagctggaggtagcattccttgggcacagtactgccttgggatcagcaaatccttttgatggtgcatttaggtgtggcaagacagctcttagagtgggaccgggatgtgcttggagacagagggaactagattgagctgcccgataaagacatgccagcctggcagagtgtagtgactcatgtctgtaatcctagtgctttgggaggctgaagtgggaggattgcttgaggccaggggtttgagatcagcctgggaaacaacaagacctctacaaaaaaaaaagaaaaaaaaaattaaccacatgtggtggcatgcacctgtagtcccagctacctggcaggctgaggtaggaggatcacttgagcccaggaaggtaaggatacattgagccatgactgtgccactgcactctagcctgggtgacagaaagagactctgtctcagaaataaattaaataaataaataaatatatagtggccatgacatccctagaaagacaaggtcctgggaataggtagaagccaagggaaatgagaaatgagagggggccctggagctggaactgggggagcaggatggcctctgagaagttcctgatagtggtgtcactgatgtgtctgatgtttagttgtaattatttgctgggcccctgtcatccctcatatctgatagctctttgctagtcaaagtgtggtctggggatcagcggcatcagcatcacttgagaacttgttagagatgcagaatctagagccccacccgggacccagaaacagagcctgcattttaacaagctccccaggtgattctcacacacactcgcatttgagaagcactgggctagttgacagattctcaggcatggctgacattgaaatatccagggagcaggcttggcattaggatgtttaaaagtcctccaggtgtttctaaagccaggtttgaggaattactgggctgatacaaatgttttgtgatgatgctttgtgtgtgtgtgtgtgtgtgtgtgtgtgtgtgtgtgtgtgtgtgtgtgtgtgtgtagggaattctgggtcacttggcaccaacacaggaaacaatggaaatatgtgagccatgacagaaaggtcaggagataaaagaaattagtgacatgagaggtactcctcaggtgttaggaaagagggtagagcaaaccaggttttccaccatatgttggatagggggtcaagtaaatttctacttaaaaattacaaacaggggctgggcgcggtggctcatgcctgtaatcccgcactttgggaggctgaggagggcggatcacaaggtcaagagattgagaccatcctggccaacacggtgaaaccgtgtctccactaaaaatacaaaaattagctgggcatggtggtgcgtgcctttattcccagctactcgggaggctgaggcaggagaatcgcttgaacctgggaggtggaggttgcagtgggccgagatcgcaccactgcaatccagagcgagactgtgtcaaaaaaaaaaaaaaaaagaaaattccaaacaggatgaccctaagcctgcaggacttggagacatctaggtgactgatactcagtcacaaaacataattggtcacaggcctgatgaaatgcacagcagaccttcagatggtatgcactcaagtgatatccacaagtccacctaaagaaatgctatattcagacatttggcatcaatctctatcaaacaaagatagtccaaagcaatgggttccaaaaacactttcctaagacaaattctctatttgcttttaatatcagtcatcccagcccttggaatagaggagcaaatgataccagtggtaccctaccacaatgcaccaaggtattatactctcatgctccattttctccctctgtctacatcactaataactcattgatttctggtgcaagccctgctgggagaaaaagtctactcttgtaccttggagcaagttgctcagagtaggtatcgaggataaaatttggaaagttagaaaagctattagaaggagatcctagtagttgaaaacacagcctggccaagtcaatgatgctatttcatctccccagccttgcatgtccatagctaaggaagacaatttaggcttgggctagaggatgggaaagggcaaaattactgatgccacagcccagagaggtattctagtaatctgagggtgaggaccacatacctggttcagggacgtacagtgttgacagctgtgagtggatgcctggagttctggcgtgtcttctagcacaatgatacctgagactcttgcatcattgggaataataaaatgggagtggatagatatgaaattatgatggcaataagcaatcagctaatagcttcattgatgggacagattaaagatggctgcaaatcctttggtccaggtttgggatataggcagcatttgtattggaatgctgatagtctgaggccatgaaaagtccacctgcagtagtggtaggaggaacaagcctcactttcttcaatgtgtgtgactgctgtcttgattccctgggtggccagttccattcgtgtggttctttggtccacttgactctggggtggctctgtgatggcttgaccaatacaatgtagtggaaatgatgctgtcatcatttccagcctcttccagccttaaggaactggcaacttttatttctgtcccttggaatacttgttcttgcaacccatccatcatacagtgagaaattctaagctgccccattaagaggcccacatggtgataaattggggtcttacatacagccctagctgtgctcctagctgacaaacagtagcaacttgtcaccaggcgagtgaaccacttaggactgtatactccagccccagttgagcaatgtggaacagagtaaaccatctcagcttagccctgcccaaactgcagaattatgagcaaaataatcccctaggctttgggctgatttgttccagattactggaacagaatttggtaccaggggtgaggtgctacagcaatgaaagcttaagacacgtgactttggttttgggtctgagtggcaggggaacttggcaggcctcaaggaaacttttagggagggttgaagcatagtgaggaaaacagtaggggaagctagaggaaaaaatgatgcttggtatgtagtggtgggaagtttagcaaaactcgcctgatgtaatgtgggaaattgtaagaactcagaacgatttaagggcatgttttataggtcctttaagaaacttctaggccaggcgcagtggctcatgtctgtaatcccagcactttgggaggctgaggtgggcggatcacaaggtcaggagatcgagacaatcctggctaacattgtgaaaccccgtctctactaaaactacaaaaaaaaattagccgggcatggtggcgggtgcctgtagtcccagctactagggaggctgaggcagaagaatggcgtgaacctgggatgtggatcttgaagtgagcccagattgtgccactgcactccagcctgggcaacagagtgagactccgtctcaaaccgaaaaaaaaaaaaaaaaaaagaaacttctagggctggtcccgtggaagcctcacacatggtacacaaaggctgtcttgaaaagaaacgtaagtgtgttttttggtttaataaaattgattataaatggataatgcaaaacattttaaagaattttactagcttacattagcagatttggatccagtgattgttacattctggtactgagcccctgaattacttctttgagtaaggcattataccaaagctattgatagttgggcttatagggtgtatgtttgaagaactactaatgtcaaaaccaatatttcacggtcgacaagaggacatcagaactggtaatccttattaccatgactggctggacagaatactcaatgtaatgggatttcctgcaaataaagacggggaagatgtaaaaaagatgcctgaacattcaacattaatgaaagatttcagaagaaatatgtatactaactgcagccttatcaagtatatggaaaaacacaaagttaaaccagatagtaaagcattccacttgcttcagaagtttcttactatggacccaataaagtgaattacctgagaacggggtccctgtttcttcgaagacccacttcctacatcagacgttttcaacagttgtcaaatcccctacccaaaatgagaatttttaacagaagaagaacctgatgacaaaggagccaaaaagaaccaccaccggcagcagggccataaccacacgaatggaactggccacccaggaatcaagacaacggtcacacacagggacccccgttgaagaaagtgaggcttgttcctcctaccactacctcaggtggacttttcacggcctcagactatccgcgttccaatccacatgctgcctatatcccaaccctggaccaagcacatcccagccgaagagcagtgtaggatactcagctacctcccagcaggctccacaggacccacgtcagacacacgggtactgagctgcatcggaatcttgtccgtgcactgttgtgaatgctgcagggctgactgtgcagctctccgtgggaacctggtatgggccatgagaatgtactgtacaaccacacctgcccagtagccaagttccttccaccgcttttcacagatcggggtagtggcttccagtttgtacctattttggagttagacctgaaaagaaagcgctagcacagtttgtgttgtggatttgctactttcatagttaacttgacctggctcagactgaccagtacttttttttccgtgacagtctatagcagttgaagctgagaatgtgctaggggcaagcgtttgtcttcatatgtcatgaattcctccagtgtaacaacattatctgaccaatagtacacacacagacacaaggtttaactggtacttgaaaacatacagtaggtgttaactcagtgaaataaccaggactcaaagtaagattattttggtacacctttcttgttagtgtcttatcagtgagttgattcattttctacattaatcagtgttttctgaccaagaatattgcttggatttttctgaaagtacaaaaagccacatagtttttttcagaaaggtttcaaaactcctaaagattaatttccaagtataagtttgtttttattttcaatctatgacttgactggtattaaagctgctatttgatagtaattagatatattctcattgatataaacctgtttggttcagcaaacaaactaaaatgattgtcacagacaatgctttatttttcctgttggtgttgcttgtgggaaaaagaaagagagatcagattgttactgtgtctgtgtagaaagaagtagacataggagactccattttgttctgtactaagaaaaattcttctgccttgagatgctgttaatctatataaccttacccccaaccctgtgctctctgaaacatgtgctgtgtccactcagggttaaatggattaagggcggtgcaagatgtgctttgttaaacagatgcttgaaggcagcatgctcgtaagagtcatcaccactccctaatctcaagtacccagggacacaaacactgctgaaggccgcagggacctctgcctaggaaagccaggtattgtccaaggtttctccccatgtgatagtctgaaatatggcctcgtgggaggggaaagacctgaccgtcccccagcccgacacccgtaaagggtctgtgctgaggaggattagtatacgaggaaggaacgcctctttgcagttgagacaagaggaaggcatctgtcttctgcccgtccctgggcaatggaatgtctcggtataaaacccgattttatgttccatctactgagataggggaaaaccaccttagggctggaggtgggacatgcggcagcaatactgctctttaagacattgagatgtttatgtgtatgcatatctaaagcacagcacttaattctttaccttgtctatgttgcagagacctttgttcacgtgtttatctgctgaccttctctccactattatcctatgaccctgccacatccccctctccgagaaacacccaagaatgatcaataaatactaagggaactcagaggccggcgggatcctccatatactgaacgcttgtcccctgggcccccttatttctttctctatacttggtctctgtgtctttttcttttccaagtctctcgttccacctaatgagaaacacccacaggtgtaaaggggcaacccaccccttcattgctgatttgtgagcgtgctttaaggtgaaaaaagcatgaatgttaacttccttaaaaaggtacagcatccaattcaaatatttttgtcctgattttaatgctagttgatgtagtgctattaaaattttgttcaacatggacacagagaggggaacaacacataccagggcctgttgcggggtggggatgaggggagggaacttagaggacaggtgaacaggtgcagcagatcaccatggcccacatatacctatttaacaaacctgcacgttctgcacacgtatcccatttctttttttttttaagaaatagaaaaaaaaataaaattttgttcactgattcttccattttaaaacttgtttgcatgtggtttaggatgcccttacttcagcaaaggagaaggaataggagggccttagaatttttgagggaaaaaaaccctataacatacattgtactgtatcaaactattttacatgaatgacacaagtattctgaataaaaaaataattgaacattgttaagaacaaggtgtcatgtaatttatttttcataaataaaaaaattatagtggcttagactgaaaggaacagagaatttaaaaaattaaaaagaagccttagtatatttttgtatatagtttccatgtgccatatttgccataattggatgagaattttttgacctctggcagggtgaccctatattttcantntataaagcgtgcatcatacc

SEQ ID NO: 88 - protein, 185 aa, Artificial Sequence
  Synthetically generated
  VARIANT (1)...(185): Xaa = Any Amino Acid
MVLKCHPPGDSQCAPGVRVTALGHATQRVSSDQQHPQLWECIRKTEAWHHPHLLNHSLQPGGPCSLSNKCLSSLQRSASAEKGSPILLGVSKGEFCLYCDKDKGQSHPSLQLKEKLMKLAAQKESARRPFIFYRAQVGSWNMLESAAHPGWFICTSCNCNEPVGIXNXVDFDLLGKAQKRGTGSE

SEQ ID NO: 89 - DNA, 746 bp, Mus sp.
  CDS (135)...(428)
gaattcggcacgagggtagtgtgcagacacattcctattcaatcagggtcaatctgcagattggcagctcagaaacaacatcaccataatgaataaggagaaagaactaagagcagcatcaccttcgcttagacatgttcaggatcttagtagtcgtgtgtggatcctgcagaacaatatcctcactgcagtcccaaggaaagagcaaacagttccaggaagggaacataatggaaatgtacaacaaaaaggaacctgtaaaagcctctctcttctatcacaagaagagtggtacaacctctacatttgagtctgcagccttccctggttggttcatcgctgtctgctctaaagggagctgcccactcattctgacccaagaactgggggaaatcttcatcactgacttcgagatgattgtggtacattaaggtttttagacacattgctctgtggcactctctcaagatttcttggattctaacaagaagcaatcaaagacacccctaacaaaatggaagactgaaaagaaagctgagccctccctgggctgtttttccttggtggtgaatcagatgaagaacatcttaccatgttttcatccaaagcatttactgttggtttttacaaggagtgaattttttaaaataaaatcatttatctcataaaaaaaaaaaaaaaaaaaaaaaaaaaaaaaaaaaaaaaaaaaaaaaaaaaaaaaaaaaaaaaaaaactctcgcggccgc

SEQ ID NO: 90 - protein, 98 aa, Mus sp.
MFRILVVVCGSCRTISSLQSQGKSKQFQEGNIMEMYNKKEPVKASLFYHKKSGTTSTFESAAFPGWFIAVCSKGSCPLILTQELGEIFITDFEMIVVH

SEQ ID NO: 91 - DNA, 294 bp, Mus sp.
  CDS (1)...(294)
atgttcaggatcttagtagtcgtgtgtggatcctgcagaacaatatcctcactgcagtcccaaggaaagagcaaacagttccaggaagggaacataatggaaatgtacaacaaaaaggaacctgtaaaagcctctctcttctatcacaagaagagtggtacaacctctacatttgagtctgcagccttccctggttggttcatcgctgtctgctctaaagggagctgcccactcattctgacccaagaactgggggaaatcttcatcactgacttcgagatgattgtggtacat

SEQ ID NO: 92 - DNA, 243 bp, Mus sp.
  CDS (1)...(243)
ctgcagtcccaaggaaagagcaaacagttccaggaagggaacataatggaaatgtacaacaaaaaggaacctgtaaaagcctctctcttctatcacaagaagagtggtacaacctctacatttgagtctgcagccttccctggttggttcatcgctgtctgctctaaagggagctgcccactcattctgacccaagaactgggggaaatcttcatcactgacttcgagatgattgtggtacat

SEQ ID NO: 93 - protein, 81 aa, Mus sp.
LQSQGKSKQFQEGNIMEMYNKKEPVKASLFYHKKSGTTSTFESAAFPGWFIAVCSKGSCPLILTQELGEIFITDFEMIVVH

SEQ ID NO: 94 - protein, 35 aa, Artificial Sequence
  Consensus Motif
  VARIANT (2)...(2): Xaa = any amino acid
  VARIANT (5)...(6): Xaa = any amino acid
  VARIANT (8)...(14): Xaa = any amino acid
  VARIANT (15)...(34): Xaa = no amino acid or any amino acid
  VARIANT (1)...(35): Xaa = Any Amino Acid
FXSAXXPXXXXXXXXXXXXXXXXXXXXXXXXXXXL

SEQ ID NO: 95 - protein, 35 aa, Artificial Sequence; identical to SEQ ID NO: 94
  Consensus Motif
  VARIANT (2)...(2): Xaa = T or E
  VARIANT (5)...(5): Xaa = A or E
  VARIANT (6)...(6): Xaa = any amino acid
  VARIANT (8)...(8): Xaa = any amino acid
  VARIANT (9)...(9): Xaa = W or L
  VARIANT (10)...(14): Xaa = any amino acid
  VARIANT (15)...(34): Xaa = no amino acid or any amino acid

SEQ ID NO: 96 - DNA, 33 bp, Artificial Sequence
  Synthetic construct
aaaaaagaattcgccaccatgttcaggatctta

SEQ ID NO: 97 - DNA, 54 bp, Artificial Sequence
  Synthetic construct
tcctctgtcgactcacttgtcgtcgtcgtccttgtagtcatgtaccacaatcat

SEQ ID NO: 98 - protein, 178 aa, Mus Musculus
MEICWGPYSHLISLLLILLFHSEAACRPSGKRPCKMQAFRIWDTNQKTFYLRNNQLIAGYLQGPNIKLEEKIDMVPIDLHSVFLGIHGGKLCLSCAKSGDDIKLQLEEVNITDLSKNKEEDKRFTFIRSEKGPTTSFESAACPGWFLCTTLEADRPVSLTNTPEEPLIVTKFYFQEDQ

SEQ ID NO: 99 - protein, 270 aa, Mus Musculus
MAKVPDLFEDLKNCYSENEDYSSAIDHLSLNQKSFYDASYGSLHETCTDQFVSLRTSETSKMSNFTFKESRVTVSATSSNGKILKKRRLSFSETFTEDDLQSITHDLEETIQPRSAPYTYQSDLRYKLMKLVRQKFVMNDSLNQTIYQDVDKHYLSTTWLNDLQQEVKFDMYAYSSGGDDSKYPVTLKISDSQLFVSAQGEDQPVLLKELPETPKLITGSETDLIFFWKSINSKNYFTSAAYPELFIATKEQSRVHLARGLPSMTDFQIS

SEQ ID NO: 100 - protein, 269 aa, Mus Musculus
MATVPELNCEMPPFDSDENDLFFEVDGPQKMKGCFQTFDLGCPDESIQLQISQQHINKSFRQAVSLIVAVEKLWQLPVSFPWTFQDEDMSTFFSFIFEEEPILCDSWDDDDNLLVCDVPIRQLHYRLRDEQQKSLVLSDPYELKALHLNGQNINQQVIFSMSFVQGEPSNDKIPVALGLKGKNLYLSCVMKDGTPTLQLESVDPKQYPKKKMEKRFVFNKIEVKSKVEFESAEFPNWYISTSQAEHKPVFLGNNSGQDIIDFTMESVSS

SEQ ID NO: 101 - DNA, 1291 bp, Homo Sapiens
  CDS (124)...(630)
aggagtcgacccacgcgtccgattagaacccatcactgaccttggaagctgctggagccacgattcagtcccctggactgtagataaagaccctttcttgccaggtgctgagacaaccacactatgagaggcactccaggagacgctgatggtggaggaagggccgtctatcaatcaatgtgtaaacctattactgggactattaatgatttgaatcagcaagtgtggacccttcagggtcagaaccttgtggcagttccacgaagtgacagtgtgaccccagtcactgttgctgttatcacatgcaagtatccagaggctcttgagcaaggcagaggggatcccatttatttgggaatccagaatccagaaatgtgtttgtattgtgagaaggttggagaacagcccacattgcagctaaaagagcagaagatcatggatctgtatggccaacccgagcccgtgaaacccttccttttctaccgtgccaagactggtaggacctccacccttgagtctgtggccttcccggactggttcattgcctcctccaagagagaccagcccatcattctgacttcagaacttgggaagtcatacaacactgcctttgaattaaatataaatgactgaactcagcctagaggtggcagcttggtctttgtcttaaagtttctggttcccaatgtgttttcgtctacattttcttagtgtcattttcacgctggtgctgagacaggagcaaggctgctgttatcatctcattttataatgaagaagaagcaattacttcatagcaactgaagaacaggatgtggcctcagaagcaggagagctgggtggtataaggctgtcctctcaagctggtgctgtgtaggccacaaggcatctgcatgagtgactttaagactcaaagaccaaacactgagctttcttctaggggtgggtatgaagatgcttcagagctcatgcgcgttacccacgatggcatgactagcacagagctgatctctgtttctgttttgctttattccctcttgggatgatatcatccagtctttatatgttgccaatatacctcattgtgtgtaatagaaccttcttagcattaagaccttgtaaacaaaaataattcttgtgttaagttaaatcatttttgtcctaattgtaatgtgtaatcttaaagttaaataaactttgtgtatttatataataataaagctaaaactgatataaaataaagaaagagtaaactgaaaaaaaaaaaaaaaaaaaaaaaaaaggcggccgc

SEQ ID NO: 102 - protein, 169 aa, Homo Sapiens
MRGTPGDADGGGRAVYQSMCKPITGTINDLNQQVWTLQGQNLVAVPRSDSVTPVTVAVITCKYPEALEQGRGDPIYLGIQNPEMCLYCEKVGEQPTLQLKEQKIMDLYGQPEPVKPFLFYRAKTGRTSTLESVAFPDWFIASSKRDQPIILTSELGKSYNTAFELNIND

SEQ ID NO: 103 - DNA, 507 bp, Homo Sapiens
  CDS (1)...(507)
atgagaggcactccaggagacgctgatggtggaggaagggccgtctatcaatcaatgtgtaaacctattactgggactattaatgatttgaatcagcaagtgtggacccttcagggtcagaaccttgtggcagttccacgaagtgacagtgtgaccccagtcactgttgctgttatcacatgcaagtatccagaggctcttgagcaaggcagaggggatcccatttatttgggaatccagaatccagaaatgtgtttgtattgtgagaaggttggagaacagcccacattgcagctaaaagagcagaagatcatggatctgtatggccaacccgagcccgtgaaacccttccttttctaccgtgccaagactggtaggacctccacccttgagtctgtggccttcccggactggttcattgcctcctccaagagagaccagcccatcattctgacttcagaacttgggaagtcatacaacactgcctttgaattaaatataaatgac

SEQ ID NO: 104 - DNA, 1377 bp, Homo Sapiens
  CDS (98)...(721)
gtcgacccacgcgtccgggaagctgctggagccacgattcagtcccctggactgtagataaagaccctttcttgccaggtgctgagacaaccacactatgagaggcactccaggagacgctgatggtggaggaagggccgtctatcaatcaagtgaatcaaatgctgttgggatggggctctggaggcttaggccctctgcactcacgctatctcctgtggaagccccagccttctctgctcctctctgtacactgcccttcccacctgtgtgtaaacctattactgggactattaatgatttgaatcagcaagtgtggacccttcagggtcagaaccttgtggcagttccacgaagtgacagtgtgaccccagtcactgttgctgttatcacatgcaagtatccagaggctcttgagcaaggcagaggggatcccatttatttgggaatccagaatccagaaatgtgtttgtattgtgagaaggttggagaacagcccacattgcagctaaaagagcagaagatcatggatctgtatggccaacccgagcccgtgaaacccttccttttctaccgtgccaagactggtaggacctccacccttgagtctgtggccttcccggactggttcattgcctcctccaagagagaccagcccatcattctgacttcagaacttgggaagtcatacaacactgcctttgaattaaatataaatgactgaactcagcctagaggtggcagcttggtctttgtcttaaagtttctggttcccaatgtgttttcgtctacattttcttagtgtcattttcacgctggtgctgagacaggagcaaggctgctgttatcatctcattttataatgaagaagaagcaattacttcatagcaactgaagaacaggatgtggcctcagaagcaggagagctgggtggtataaggctgtcctctcaagctggtgctgtgtaggccacaaggcatctgcatgagtgactttaagactcaaagaccaaacactgagctttcttctaggggtgggtatgaagatgcttcagagctcatgcgcgttacccacgatggcatgactagcacagagctgatctctgtttctgttttgctttattccctcttgggatgatatcatccagtctttatatgttgccaatatacctcattgtgtgtaatagaaccttcttagcattaagaccttgtaaacaaaaataattcttgtgttaagttaaatcatttttgtcctaattgtaatgtgtaatcttaaagttaaataaactttgtgtatttatataataataaagctaaaactgatataaaataaagaaagagtaaactgaaaaaaaaaaaaaaaaaaaagggcggccgc

SEQ ID NO: 105 - protein, 208 aa, Homo Sapiens
MRGTPGDADGGGRAVYQSSESNAVGMGLWRLRPSALTLSPVEAPAFSAPLCTLPFPPVCKPITGTINDLNQQVWTLQGQNLVAVPRSDSVTPVTVAVITCKYPEALEQGRGDPIYLGIQNPEMCLYCEKVGEQPTLQLKEQKIMDLYGQPEPVKPFLFYRAKTGRTSTLESVAFPDWFIASSKRDQPIILTSELGKSYNTAFELNIND

SEQ ID NO: 106 - DNA, 624 bp, Homo Sapiens
  CDS (1)...(624)
atgagaggcactccaggagacgctgatggtggaggaagggccgtctatcaatcaagtgaatcaaatgctgttgggatggggctctggaggcttaggccctctgcactcacgctatctcctgtggaagccccagccttctctgctcctctctgtacactgcccttcccacctgtgtgtaaacctattactgggactattaatgatttgaatcagcaagtgtggacccttcagggtcagaaccttgtggcagttccacgaagtgacagtgtgaccccagtcactgttgctgttatcacatgcaagtatccagaggctcttgagcaaggcagaggggatcccatttatttgggaatccagaatccagaaatgtgtttgtattgtgagaaggttggagaacagcccacattgcagctaaaagagcagaagatcatggatctgtatggccaacccgagcccgtgaaacccttccttttctaccgtgccaagactggtaggacctccacccttgagtctgtggccttcccggactggttcattgcctcctccaagagagaccagcccatcattctgacttcagaacttgggaagtcatacaacactgcctttgaattaaatataaatgac

SEQ ID NO: 107 - protein, 38 aa, Artificial Sequence
  Consensus Motif
  VARIANT (1)...(2): Xaa = any amino acid
  VARIANT (4)...(4): Xaa = Ala, Ser, Leu or Val
  VARIANT (5)...(6): Xaa = any amino acid
  VARIANT (8)...(9): Xaa = any amino acid
  VARIANT (10)...(10): Xaa = Phe, Tyr, Leu, Ile, or Val
  VARIANT (11)...(11): Xaa = Leu or Ile
  VARIANT (13)...(17): Xaa = any amino acid
  VARIANT (18)...(37): Xaa = no amino acid or any amino acid
  VARIANT (38)...(38): Xaa = Leu, Ile, Val or Met
XXSXXXPXXXXXXXXXXXXXXXXXXXXXXXXXXXXXXX

SEQ ID NO: 108 - protein, 35 aa, Artificial Sequence; identical to SEQ ID NO: 94
  Consensus Motif
  VARIANT (2)...(2): Xaa = Any amino acid
  VARIANT (5)...(6): Xaa = Any amino acid
  VARIANT (8)...(14): Xaa = Any amino acid
  VARIANT (15)...(34): Xaa = no amino acid or any amino acid
  VARIANT (1)...(35): Xaa = Any Amino Acid

SEQ ID NO: 109 - protein, 44 aa, Artificial Sequence
  Consensus Motif
  VARIANT (2)...(3): Xaa = any amino acid
  VARIANT (5)...(6): Xaa = any amino acid
  VARIANT (9)...(10): Xaa = any amino acid
  VARIANT (12)...(14): Xaa = any amino acid
  VARIANT (19)...(20): Xaa = any amino acid
  VARIANT (24)...(25): Xaa = any amino acid
  VARIANT (27)...(27): Xaa = any amino acid
  VARIANT (29)...(29): Xaa = any amino acid
  VARIANT (33)...(33): Xaa = any amino acid
  VARIANT (36)...(36): Xaa = any amino acid
  VARIANT (40)...(40): Xaa = any amino acid
QXXEXXIMXXYXXXEPVKXXLFYXXKXGXTSTXESXAFPXWFIA

SEQ ID NO: 110 - protein, 68 aa, Artificial Sequence
  Consensus Motif
  VARIANT (2)...(3): Xaa = any amino acid
  VARIANT (5)...(6): Xaa = any amino acid
  VARIANT (9)...(10): Xaa = any amino acid
  VARIANT (12)...(14): Xaa = any amino acid
  VARIANT (19)...(20): Xaa = any amino acid
  VARIANT (24)...(25): Xaa = any amino acid
  VARIANT (27)...(27): Xaa = any amino acid
  VARIANT (29)...(29): Xaa = any amino acid
  VARIANT (33)...(33): Xaa = any amino acid
  VARIANT (36)...(36): Xaa = any amino acid
  VARIANT (40)...(40): Xaa = any amino acid
  VARIANT (45)...(49): Xaa = any amino acid
  VARIANT (50)...(50): Xaa = no amino acid or any amino acid
  VARIANT (51)...(51): Xaa = any amino acid
  VARIANT (53)...(53): Xaa = any amino acid
  VARIANT (57)...(57): Xaa = any amino acid
  VARIANT (61)...(64): Xaa = any amino acid
  VARIANT (66)...(66): Xaa = any amino acid
QXXEXXIMXXYXXXEPVKXXLFYXXKXGXTSTXESXAFPXWFIAXXXXXXXPXILTXELGXXXXTXFE

SEQ ID NO: 111 - protein, 35 aa, Artificial Sequence; identical to SEQ ID NO: 94
  Consensus Motif
  VARIANT (2)...(2): Xaa = T or E
  VARIANT (5)...(5): Xaa = A or E
  VARIANT (6)...(6): Xaa = any amino acid
  VARIANT (8)...(8): Xaa = any amino acid
  VARIANT (9)...(9): Xaa = W or L
  VARIANT (10)...(14): Xaa = any amino acid
  VARIANT (15)...(34): Xaa = no amino acid or any amino acid

SEQ ID NO: 112 - DNA, 838 bp, Mus Musculus
  CDS (96)...(575)
cgggtcgacccacgcgtccgctgtagtgtgcagacacattcctattcaatcagggtcaatctgcagattggcagctcagaaacaacatcaccataatgaataaggagaaagaactaagagcagcatcaccttcgcttagacatgttcaggatcttagtagtcgtgtgtggatcctgcagaacaatatcctcactgcagtcccaaggaaagagcaaacagttccagtcactattaccttgctcccatgccaatatctggacactcttgagacgaacaggggggatcccacgtacatgggagtgcaaaggccgatgagctgcctgttctgcacaaaggatggggagcagcctgtgctacagcttggggaagggaacataatggaaatgtacaacaaaaaggaacctgtaaaagcctctctcttctatcacaagaagagtggtacaacctctacatttgagtctgcagccttccctggttggttcatcgctgtctgctctaaagggagctgcccactcattctgacccaagaactgggggaaatcttcatcactgacttcgagatgattgtggtacattaaggtttttagacacattgctctgtggcactctctcaagatttcttggattctaacaagaagcaatcaaagacacccctaacaaaatggaagactgaaaagaaagctgagccctccctgggctgtttttccttggtggtgaatcagatgcagaacatcttaccatgttttcatccaaagcatttactgttggtttttacaaggagtgaattttttaaaataaaatcatttatctcatttgaaaaaaaaaaaaaaaaaagggc

SEQ ID NO: 113 - protein, 160 aa, Mus Musculus
MNKEKELRAASPSLRHVQDLSSRVWILQNNILTAVPRKEQTVPVTITLLPCQYLDTLETNRGDPTYMGVQRPMSCLFCTKDGEQPVLQLGEGNIMEMYNKKEPVKASLFYHKKSGTTSTFESAAFPGWFIAVCSKGSCPLILTQELGEIFITDFEMIVVH

SEQ ID NO: 114 - DNA, 480 bp, Mus Musculus
  CDS (1)...(480)
atgaataaggagaaagaactaagagcagcatcaccttcgcttagacatgttcaggatcttagtagtcgtgtgtggatcctgcagaacaatatcctcactgcagtcccaaggaaagagcaaacagttccagtcactattaccttgctcccatgccaatatctggacactcttgagacgaacaggggggatcccacgtacatgggagtgcaaaggccgatgagctgcctgttctgcacaaaggatggggagcagcctgtgctacagcttggggaagggaacataatggaaatgtacaacaaaaaggaacctgtaaaagcctctctcttctatcacaagaagagtggtacaacctctacatttgagtctgcagccttccctggttggttcatcgctgtctgctctaaagggagctgcccactcattctgacccaagaactgggggaaatcttcatcactgacttcgagatgattgtggtacat

SEQ ID NO: 115 - DNA, 1564 bp, Homo Sapiens
  CDS (97)...(393)
ctggtctcaaactcctgactaatgtggtgaaaccccatctctactaaaaatacaaaaattagccgggcataaccacgccgcgcccctccggtcagcatgaggctcctggcggccgcgctgctcctgctgctgctggcgctgtacaccgcgcgtgtggacgggtccaaatgcaagtgctcccggaagggacccaagatccgctacagcgacgtgaagaagctggaaatgaagccaaagtacccgcactgcgaggagaagatggttatcatcaccaccaagagcgtgtccaggtaccgaggtcaggagcactgcctgcaccccaagctgcagagcaccaagcgcttcatcaagtggtacaacgcctggaacgagaagcgcagggtctacgaagaatagggtgaaaaacctcagaagggaaaactccaaaccagttgggagacttgtgcaaaggactttgcagattaaaaaaaaaaaaaaaaaaagcctttctttctcacaggcataagacacaaattatatattgttatgaagcactttttaccaacggtcagtttttacattttatagctgcgtgcgaaaggcttccagatgggagacccatctctcttgtgctccagacttcatcacaggctgctttttatcaaaaaggggaaaactcatgcctttcctttttaaaaaatgcttttttgtatttgtccatacgtcactatacatctgagctttataagcgcccgggaggaacaatgagcttggtggacacatttcattgcagtgttgctccattcctagcttgggaagcttccgcttagaggtcctggcgcctcggcacagctgccacgggctctcctgggcttatggccggtcacagcctcagtgtgactccacagtggcccctgtagccgggcaagcaggagcaggtctctctgcatctgttctctgaggaactcaagtttggttgccagaaaaatgtgcttcattcccccctggttaatttttacacaccctaggaaacatttccaagatcctgtgatggcgagacaaatgatccttaaagaaggtgtggggtctttcccaacctgaggatttctgaaaggttcacaggttcaatatttaatgcttcagaagcatgtgaggttcccaacactgtcagcaaaaaccttaggagaaaacttaaaaatatatgaatacatgcgcaatacacagctacagacacacattctgttgacaagggaaaaccttcaaagcatgtttctttccctcaccacaacagaacatgcagtactaaagcaatatatttgtgattccccatgtaattcttcaatgttaaacagtgcagtcctctttcgaaagctaagatgaccatgcgccctttcctctgtacatatacccttaagaacgccccctccacacactgccccccagtatatgccgcattgtactgctgtgttatatgctatgtacatgtcagaaaccattagcattgcatgcaggtttcatattctttctaagatggaaagtaataaaatatatttgaaatgtaaaaaaaaaaaaaaaaaaaaaaaaa

SEQ ID NO: 116 - protein, 99 aa, Homo Sapiens
MRLLAAALLLLLLALYTARVDGSKCKCSRKGPKIRYSDVKKLEMKPKYPHCEEKMVIITTKSVSRYRGQEHCLHPKLQSTKRFIKWYNAWNEKRRVYEE

SEQ ID NO: 117 - DNA, 300 bp, Homo Sapiens
  CDS (1)...(297)
atgaggctcctggcggccgcgctgctcctgctgctgctggcgctgtacaccgcgcgtgtggacgggtccaaatgcaagtgctcccggaagggacccaagatccgctacagcgacgtgaagaagctggaaatgaagccaaagtacccgcactgcgaggagaagatggttatcatcaccaccaagagcgtgtccaggtaccgaggtcaggagcactgcctgcaccccaagctgcagagcaccaagcgcttcatcaagtggtacaacgcctggaacgagaagcgcagggtctacgaagaatag

SEQ ID NO: 118 - DNA, 1656 bp, Mus Musculus
  CDS (212)...(508)
ggagatcgcagcacccagcgccaagcgcagcgcggcaccgcgacagacggcaggagcacccatcgacgggcgtacgtggagcgagccgagcagagcagagagaggcgtgcttgaaaccgagaaccaagccgggcggcatcccccggccgccgcacgcacaggccggcgccctccttgcctccctgctccccaccgcgcccctccggccagcatgaggctcctggcggccgcgctgctcctgctgctcctggcgctgtgcgcctcgcgcgtggacgggtccaagtgtaagtgttcccggaaggggcccaagatccgctacagcgacgtgaagaagctggaaatgaagccaaagtacccacactgcgaggagaagatggttatcgtcaccaccaagagcatgtccaggtaccggggccaggagcactgcctgcaccctaagctgcagagcaccaaacgcttcatcaagtggtacaatgcctggaacgagaagcgcagggtctacgaagaatagggtggacgatcatggaaagaaaaactccaggccagttgagagacttcagcagaggactttgcagattaaaataaaagccctttctttctcacaagcataagacaaattatatattgctatgaagctcttcttaccagggtcagtttttacattttatagctgtgtgtgaaaggcttccagatgtgagatccagctcgcctgcgcaccagacttcattacaagtggctttttgctgggcggttggcggggggcggggggacctcaagcctttcctttttaaaataaggggttttgtatttgtccatatgtcaccacacatctgagctttataagcgcctgggaggaacagtgagcatggttgagaccgttcacagcactactgctccgctccaggcttacaaagcttccgctcagagagcctggcggctctgcgcagctgccacaggctctcctgggcttatgactggtcagagtttcagtgtgactccactgtggcccctgttgcagggcaattgggagcaggtccttctacatctgtgcctagaggaactcagtctacttaccagaaggagcttcatccccaccccacccccacccgcaccccagctcattcccctgtcacgaccaggcaagtgatccttaaaggagctgggtctttttcttgcaaactgagggtttctgaaaggtcccctgctttggtagaagatgcttctgaggcatccaaagtccccagcagtgtgagaaaatgatgctcgatgttcgggaggacaagggaagatgcaggattagatgcaggacacacagccagagctacacatcctcttggcaatgggagctcccccccccaaagctttgtttctttccctcaccccaacagaaagtgcactccccctcagtgaatacgcaaacagcactgttctctgagttaggatgttaggacgatcctgcgccctgccctctcctgtgtacatattgccttcagtacccctcccccaccccatgccacacactgcccctcattagaggccgcactgtatggctgtgtatctgctatgtaaatgctgagacccctgagtgctgcatgcaggtttcatgttctttctaagatgaaaagagaaagtaataaaatatatttgaagttacca

SEQ ID NO: 119 - protein, 99 aa, Mus Musculus
MRLLAAALLLLLLALCASRVDGSKCKCSRKGPKIRYSDVKKLEMKPKYPHCEEKMVIVTTKSMSRYRGQEHCLHPKLQSTKRFIKWYNAWNEKRRVYEE

SEQ ID NO: 120 - DNA, 300 bp, Mus Musculus
  CDS (1)...(297)
atgaggctcctggcggccgcgctgctcctgctgctcctggcgctgtgcgcctcgcgcgtggacgggtccaagtgtaagtgttcccggaaggggcccaagatccgctacagcgacgtgaagaagctggaaatgaagccaaagtacccacactgcgaggagaagatggttatcgtcaccaccaagagcatgtccaggtaccggggccaggagcactgcctgcaccctaagctgcagagcaccaaacgcttcatcaagtggtacaatgcctggaacgagaagcgcagggtctacgaagaatag

SEQ ID NO: 121 - DNA, 1372 bp, Rattus norvegicus
  CDS (1)...(234)
gggtccaagtgtaagtgttcccggaaggggcccaagatccgctacagcgacgtgaagaagctggaaatgaagccaaagtacccacactgcgaggagaagatggttatcataaccaccaagagcatgtccaggtaccgcggccaggagcactgcctgcatcctaagctgcaaagtaccaagcgcttcatcaaatggtacaacgcctggaacgagaaacgcagggtctacgaagagtagggtggacgatcttggaaagaaaacctccaggccagttgagagacttcagcagaggactttgcagattaaaaataaaagccctttctttctcacaagcataagacaaattatatattgctgtgaagctcttcttaccagggtcagtttttacattttatagctgtgtgcgaaagccttccagatgtgagatccagctctcctgcgtaccagacttcattacaagtggctttttgccgggggttggggggttgggggtgggcccaagcctttcctttttaaaataagggtttttgtatttgtccatatgtcaccacacatctgaactttataagcgcctggaaggagcaatcagtatggttcaggcaattcattgcactgttgctccggtccaggctttcgaagcttcctctcagagagcctggcgcctcggcacagctgccacaggctctcctgggcttatgactggtcaagagtttcggtgtggctccaccatggcccctgttgcagggcaattgggaacaagtccttctgcatctgtgcctagaggaactcaatctacttcccaggatgagcttcatgcccccaccccagccccacccccaccccagctcattcccctatcccaaccaggcaagcgatccttaaaggagctgggtcthtctctcgcaacctmtgagggtttctgaaaggctcactgctttggtagatgatgcttctgaagcatcagaagcccccggcagcgtgagaaaactgtgtggaggaaaaggggaaaattcaggactcaatgcatgacatccagccagagctacacatcctactggcatggggagacccacgtagctctgttcccctcgcccccacagaaagcgcactcccccttcggtgcatatgcaaacagcgaggtcctcttttggagttaggatgaccctgcaccctctcctgtgtacatattgcttcagtacccgcccctgccacacgctgcccctcagtagaggccgcactggacggctgtgaatctgctatgtaagtgctgagattcatgagtgctgcatgcgggtttcatgttctttctaagatgaaaaagaaagtaataaaaatatatttgaakktwmcmaaaaaaaaaaaaaaaaaaaaa

SEQ ID NO: 122 - protein, 78 aa, Rattus norvegicus
GSKCKCSRKGPKIRYSDVKKLEMKPKYPHCEEKMVIITTKSMSRYRGQEHCLHPKLQSTKRFIKWYNAWNEKRRVYEE

SEQ ID NO: 123 - DNA, 237 bp, Rattus norvegicus
  CDS (1)...(234)
gggtccaagtgtaagtgttcccggaaggggcccaagatccgctacagcgacgtgaagaagctggaaatgaagccaaagtacccacactgcgaggagaagatggttatcataaccaccaagagcatgtccaggtaccgcggccaggagcactgcctgcatcctaagctgcaaagtaccaagcgcttcatcaaatggtacaacgcctggaacgagaaacgcagggtctacgaagagtag

SEQ ID NO: 124 - DNA, 1458 bp, Unknown
  Macaque
  CDS (3)...(284)
cggccgcgctactcctgctgctgctggcgctgtacaccgcgcgcgtggacgggtccaaatgcaagtgctcccggaagggacccaagattcgctacagcgacgtgaagaagctggaaatgaagccaaagtacccgcactgcgaggagaagatggttatcatcaccaccaagagcgtgtccaggtaccgaggtcaggagcactgcctgcaccccaagctgcagagcaccaaacgcttcatcaagtggtacaacgcctggaacgagaagcgcagggtctacgaagaatagggtgaaaaatctctgatgggaaaactccagaccagttgggagacttgtgcaaaggactttgcagatttaaaaaaaaaaaaaaaaagcctttctttctcccaggcataagacacaagttatatattgttatgaagcactttttaccaacggtcagtttttacattttatagctgcgtgcgaaaggcttccagatgtgagacccatctctcttgtgctccagacttcatcacaggctgctttttatcgaaaaggggaaaactcatgcctttcctttttaagaaatgcttttttgtatttgtccatatgtcactatacatctgagctttataagcgcccgggaggaacaatgagcttggtggacacatttcattgcagtgttactccattcctagcttgggaagcttccgctcagaggtcctggcgcctcggcacagctgccacgggctctcctgggcttatggccggtcacagcctcagtgtgactctgcagtggcccctgtagccgggcaagcaggagcaggtctctctgcatctgttctttgaggaactcaagtttggttgccagaaaaatgtgcttcattcccccctggttaatttttacacaccctaggaaacatttccaagatcctgtgatggcgagacaaatgatccttaaagaagatgtggggtctttcccaacctgagactttctgaaaggttcacaggttcaatatttaatgcttcagaagcatgtgaggttcccaacactgtcagcaaaaaccttaggagaaaacttaaaaatatatgaatacatgcacaatacacagctacagactcacattctgttgacaagggaaaaccttcaaagcatgtttctctccctcaccacaacggaacatgcagtactaaagcaatatatttgtgattccccatgtaattcttcaatgttaaacagtgcagtcctctttcaaaagctaagatgaccatgcgccctttcctctgtacatatacccttaagaacgccccctccacacactgccctccagtatacgccgcattgtactgctgtgttatatgctacgtacatgtcagaaaccattagcattgcatgcaggtttcatattctttctaagatggaaagtaataaaatatatttgaaatgtaaaaaaaaaaaaaaaaaaaaaaaaaaaaa

SEQ ID NO: 125 - DNA, 20 bp, Artificial Sequence
  Primer
ccaagcgcttcatcaagtgg

SEQ ID NO: 126 - DNA, 21 bp, Artificial Sequence
  Primer
gcagcctgtgatgaagtctgg

SEQ ID NO: 127 - DNA, 24 bp, Artificial Sequence
  Primer
cagcctattcttcgtagaccctgc

SEQ ID NO: 128 - DNA, 478 bp, Artificial Sequence
  Probe
gtccaagtgtaagtgttcccggaaggggcccaagatccgctacagcgacgtgaagaagctggaaatgaagccaaagtacccacactgcgaggagaagatggttatcgtcaccaccaagagcatgtccaggtaccggggccaggagcactgcctgcaccctaagctgcagagcaccaaacgcttcatcaagtggtacaatgcctggaacgagaagcgcagggtctacgaagaatagggtggacgatcatggaaagaaaaactccaggccagttgagagacttcagcagaggactttgcagattaaaataaaagccctttctttctcacaagcataagacaaattatatattgctatgaagctcttcttaccagggtcagtttttacattttatagctgtgtgtgaaaggcttccagatgtgagatccagctcgcctgcgcaccagacttcattacaagtggctttttgctgggcggttg

SEQ ID NO: 129 - DNA, 2050 bp, Homo Sapiens
  CDS (91)...(1176)
cgaggcggggagccgaggccgccgccagcgcgcagggagccccgagcccgagccccgccgcgaggccgttcgccggctgcccgcagcaccatggatctgcacctcttcgactacgccgagccaggcaacttctccgacataagctggccgtgcaacagcagcgactgcatcgtcgtggacaccgtgctgtgccccaacatgcccaacaaaagcgtgctgctgtacacgctgtccttcatttacatcttcatcttcgtgatcggcatgatcgccaactccgtggtggtctgggtgaacatccaggccaagaccaccggctacgacactcactgctacatcctcaacctggccatcgccgacctgtgggtggtcgtcaccatccccgtctgggtggtcagcctcgtgcagcataaccagtggcccatgggggagctcacgtgcaagatcacgcacctcatcttctccatcaacctgttcggcagcatcttcttcctcacgtgcatgagcgtggaccgctacctctccatcacctacttcgccagcacgtcgagccgcaggaagaaggtggttcgccgcgccgtctgtgtcctggtgtggctgctggccttctgcgtgtccctgcccgacacctactacctgaagaccgtcacgtcggcgtccaacaacgagacctactgccgctccttctaccccgagcacagcgtcaaggagtggctcatcagcatggagctggtctcggtggtcctgggcttcgccatccccttctgcgtcatcgccgtcttctactgcctgctggcccgcgccatctccgcgtccagcgaccaggagaagcagagcagccgaaagatcatcttctcctacgtggtggtcttcctcgtgtgctggctcccctaccacgtggtggtgctcctggacatcttctccatccttcactacatccccttcacctgccagctggagaacttcctcttcacggctctgcacgtcacgcagtgcctgtctctggtgcactgctgcgtcaaccccgtgctctatagcttcatcaaccgtaactacagatacgagctgatgaaggccttcatctttaagtactcggccaagacgggtctcaccaagctcatcgatgcctccagggtgtcggagacggagtactccgccttggagcaaaacgccaagtgacaggccccgcggggcctcggggacaagcgtgcgcgcttcctacacggcgctgggttgcatcgtctccaagagttcaagcaaggcgccttggggcttgaggcctgagtcgcgtgaagtggggaagcaggtgccaccgtgggcccttctcctctttgtccggctgccggggtggctgtcacggggccgtcgtgcctgcaggcgtgggccgtgctgcgtgaccctactacttactcgtccaagccggttgccggcgggctcgcctgcacttctgtaaaataggactttctgtgttccctggaggttttacttggtgacttgtatttaagttttaagactttattttctcattatcggcgtaccttataaatgtacttgaaagtttaaatatattttataaaaatcgtatgggcgctgtcacatacgatacatatacatacgctgacatatattcagagcgttgtagttttaactagtttgatttcagttttgactaaggatgacattaattgttagctgttttgaaattttatatatatatataaatataaatataaatatataaatatataaatatatgccggtctgggctgaaatgttttatttacgatagttttatatctgtgtggtgctttgctacctgcatgggatatgggacaagaaggacgctgtaaagcagtttgtgatattaattgtatcgtaaagttacattaaaaatgcgaaacgaagcggaacctctccaggctgcagcgccgcgcacaaagttttgaacagtcttatttcggagagttctctcaatttgtaagttatttttctttttttttttttttaataaagatttgtttttcctaaaaaaggcaaaaaaaaaaaaaaa

SEQ ID NO: 130 - protein, 362 aa, Homo Sapiens
MDLHLFDYAEPGNFSDISWPCNSSDCIVVDTVLCPNMPNKSVLLYTLSFIYIFIFVIGMIANSVVVWVNIQAKTTGYDTHCYILNLAIADLWVVVTIPVWVVSLVQHNQWPMGELTCKITHLIFSINLFGSIFFLTCMSVDRYLSITYFASTSSRRKKVVRRAVCVLVWLLAFCVSLPDTYYLKTVTSASNNETYCRSFYPEHSVKEWLISMELVSVVLGFAIPFCVIAVFYCLLARAISASSDQEKQSSRKIIFSYVVVFLVCWLPYHVVVLLDIFSILHYIPFTCQLENFLFTALHVTQCLSLVHCCVNPVLYSFINRNYRYELMKAFIFKYSAKTGLTKLIDASRVSETEYSALEQNAK

SEQ ID NO: 131 - DNA, 1860 bp, Mus Musculus
  CDS (89)...(1174)
cactgaaggagcctgcagcgctcaccgtcaggaaggcaaaccacagcccaggaagccctgaggtcacttggtcgctctcctcaagaccatggatgtgcacttgtttgactatgcagagcctggcaactactctgacatcaactggccatgtaacagcagcgactgcattgtggtggacactgtgcagtgtcccaccatgcctaacaagaacgtgcttctgtataccctctccttcatctacattttcatcttcgtgatcggcatgattgccaactctgtggtggtctgggtgaatatccaggctaagaccacaggctacgacacgcactgctacatcttgaacctggccattgcagacctgtgggtcgtcatcaccacccccgtctgggtggtcagtctcgtgcagcataaccagtggcccatgggggagctcacatgcaagatcacacacctcattttctccatcaacctctttgggagcatcttcttcctcgcctgcatgagcgtggaccgctatctctccatcacctacttcaccggcacctccagctataagaagaagatggtacgccgtgttgtatgcatcttggtgtggctgctggccttctttgtgtccctgcctgatacctactacctgaaggcggtcacatctgcttccaacaatgagacctactgcaggtccttctaccccgagcacagcatcaaggagtggctgatcggcatggagctggtctctgtcatcttgggctttgctgtccccttcactatcattgcgatcttctacttcctgctcgctagagccatgtcagcatcaggcgaccaggagaagcacagtagccggaagatcatcttctcctacgtggtggtcttcctggtatgttggctgccgtaccattttgtggttctgctggacatcttctccatcttacactacatcccgtttacctgtcagctggagaatgtgctctttacagcgttgcatgtcacccagtgcctgtccttggtgcactgctgtgtcaaccccgtgctctatagcttcatcaaccgcaactacaggtacgagctgatgaaggccttcatcttcaagtactcggccaaaacaggtctcaccaagctcattgatgcctccagagtgtcagagacagagtactctgccctggaacagaacaccaagtgatccatcattctgcagaggtcggggggacacgtgcatgttgcaaatggggcggctgggtcctgtggtttcttcaagaaagcaatgtagctttgggtctggttgcttgagtggtatgaagaggagaaagcatgtgaccatgcttcctgtctctcattctccagccaagatggctgccgcctggatgcccatcctgacagctggcagctggcagcaggcagggctgtgctgtgctgtgctgtgctgcgctgtgctgtgctgtgcagccagagctgcgtatcaaagccagcaccaggacaggctcttatggacatgtgtacagtagaatcttctgtgtttcttcaagtttttacttggtgactttttgtatttaagttttaagactttattttctcactatggatgtaccttataaatgtatttgaaagctaaatatattttaaatattgtatgggaggtgtaaggctgttgtattcagaccatgtaggcctcagattagctggacttgagttttgactaaggatgacattaattgttagctgatttgaaattatatatataaatataaaaatatatataaatttatgccagtctcggctgaaaggttttatttacaatagttttatatctgtgcaatgtttaatgctggcacagcatatgaaacaacaactgcccagcaatgcagt

SEQ ID NO: 132 - protein, 362 aa, Mus Musculus
MDVHLFDYAEPGNYSDINWPCNSSDCIVVDTVQCPTMPNKNVLLYTLSFIYIFIFVIGMIANSVVVWVNIQAKTTGYDTHCYILNLAIADLWVVITTPVWVVSLVQHNQWPMGELTCKITHLIFSINLFGSIFFLACMSVDRYLSITYFTGTSSYKKKMVRRVVCILVWLLAFFVSLPDTYYLKAVTSASNNETYCRSFYPEHSIKEWLIGMELVSVILGFAVPFTIIAIFYFLLARAMSASGDQEKHSSRKIIFSYVVVFLVCWLPYHFVVLLDIFSILHYIPFTCQLENVLFTALHVTQCLSLVHCCVNPVLYSFINRNYRYELMKAFIFKYSAKTGLTKLIDASRVSETEYSALEQNTK

SEQ ID NO: 133 - DNA, 1895 bp, Canis familiaris
  CDS (1)...(1086)
  misc_feature (1)...(1895): n = A,T,C or G
atggatctgcacctcttcgactacncngagccaggnaacttctcggacatcagctggccatgcaacagcagcgactgcatcgtggtggacacggtgatgtgtcccaacatgcccaacaaaagcgtcctgctctacacgctctccttcatttacattttcatcttcgtcatcggcatgattgccaactccgtggtggtctgggtgaatatccaggccaagaccacaggctatgacacgcactgctacatcttgaacctggccattgccgacctgtgggttgtcctcaccatcccagtctgggtggtcagtctcgtgcagcacaaccagtggcccatgggcgagctcacgtgcaaagtcacacacctcatcttctccatcaacctcttcagcngcattttcttcctcacgtgcatgagcgtggaccgctacctctccatcacctacttcaccaacacccccagcagcaggaagaagatggtacgccgtgtcgtctgcatcctggtgtggctgctggccttctgcgtgtctctgcctgacacctactacctgaagaccgtcacgtctgcgtccaacaatgagacctactgccggtccttctaccccgagcacagcatcaaggagtggctgatcggcatggagctggtctccgttgtcttgggctttgccgttcccttctccattatcgctgtcttctacttcctgctggccagagccatctcggcgtccagtgaccaggagaagcacagcagccggaagatcatcttctcctacgtggtggtcttccttgtctgctggntgccctaccacgtggcggtgctgctggacatcttctccatcctgcactacatccctttcacctgccggctggagcacgccctcttcacggccctgcatgtcacacagtgcctgtcgctggtgcactgctgcgtcaaccctgtcctctacagcttcatcaatcgcaactacaggtacgagctgatgaaggccttcatcttcaagtactcggccaaaacagggctcaccaagctcatcgatgcctccagagtntcngagacggagtactcngccttggagcanancnccaaatgatctgccctggagaggctctgggacgggtttacttgtttttgaacagggtgatgggccctatggttttctagagcaaagcaaagtagcttcgggtcttgatgcttgagtagagtgaagaggggagcacgtgccccctgcatccattntctctttctcttgatgacgcagctgtcatttggctgtgcgtgctgacagttttgcaacaggcagagctgtgtcgcacagcagtgctgtgcgtcagagccagctgaggacaggcttgcctggacttctgtaagataggattttctgtgtttcctgaattttttatatggtgatttgtatttaaattttaagactttattttctcactattggtgtaccttataaatgtatttgaaagttaaatatattttaaatattgtttgggaggcatagtgctgacatatattcagagtgttgtagttttaaggttagcgtgactttcagttttgactaaggatgacactaattgttagctgttttgaaattatatatatataaatatataaatatatgccagtcttggctgaaatgttttatttaccatagttttatatctgtgtggtgttttgtaccggcacgggatatggaacgaaaactgctttgtaatgcagtttgtgacattaatagtattgtaaagttacattttaaaataaacaaaaaactgttctggactgcaaatctgcacacacaacgaacagttgcatttcagagagttctctcaatttgtaagttatttttttttaataaagatttttgtttcctaaaaaaaaaaaaaaaaaaaa

SEQ ID NO: 134 - protein, 362 aa, Canis familiaris
  VARIANT (9)...(9): Xaa = T, P, A or S
  VARIANT (131)...(131): Xaa = S, R, G or C
  VARIANT (266)...(266): Xaa = M, L or V
  VARIANT (355)...(355): Xaa = S
  VARIANT (359)...(359): Xaa = Q or H
  VARIANT (360)...(360): Xaa = N, T, S or I
  VARIANT (361)...(361): Xaa = T, P, A or S
MDLHLFDYXEPGNFSDISWPCNSSDCIVVDTVMCPNMPNKSVLLYTLSFIYIFIFVIGMIANSVVVWVNIQAKTTGYDTHCYILNLAIADLWVVLTIPVWVVSLVQHNQWPMGELTCKVTHLIFSINLFSXIFFLTCMSVDRYLSITYFTNTPSSRKKMVRRVVCILVWLLAFCVSLPDTYYLKTVTSASNNETYCRSFYPEHSIKEWLIGMELVSVVLGFAVPFSIIAVFYFLLARAISASSDQEKHSSRKIIFSYVVVFLVCWXPYHVAVLLDIFSILHYIPFTCRLEHALFTALHVTQCLSLVHCCVNPVLYSFINRNYRYELMKAFIFKYSAKTGLTKLIDASRVSETEYSALEXXXK

SEQ ID NO: 135 - protein, 94 aa, Unknown
  Macaque
AALLLLLLALYTARVDGSKCKCSRKGPKIRYSDVKKLEMKPKYPHCEEKMVIITTKSVSRYRGQEHCLHPKLQSTKRFIKWYNAWNEKRRVYEE

SEQ ID NO: 136 - DNA, 285 bp, Unknown
  Macaque
  CDS (1)...(282)
gccgcgctactcctgctgctgctggcgctgtacaccgcgcgcgtggacgggtccaaatgcaagtgctcccggaagggacccaagattcgctacagcgacgtgaagaagctggaaatgaagccaaagtacccgcactgcgaggagaagatggttatcatcaccaccaagagcgtgtccaggtaccgaggtcaggagcactgcctgcaccccaagctgcagagcaccaaacgcttcatcaagtggtacaacgcctggaacgagaagcgcagggtctacgaagaatag

SEQ ID NO: 137 - DNA, 2570 bp, Homo Sapiens
  CDS (99)...(1388)
gtcgacccacgcgtccgggccgcggcgccgagtcgaacggggagccgagctggagctaccgcggcgcagccaggccggcgaccaccaggggcctgaggatgaagccaagtctgctgtgccggcccctgtcctgcttccttatgctgctgccctggcctctcgccaccctgacatcaacaaccctttggcagtgcccacctggggaggagcccgacctggacccagggcagggcacattatgcaggccctgccccccaggcaccttctcagctgcatggggctccagcccatgccagccccatgcccgttgcagcctttggaggaggctggaggcccaggtgggcatggcaactcgagatacactctgtggagactgctggcctgggtggtttgggccttggggggttccccgcgttccatgtcaaccatgttcctgggcacctctgggtactcatggctgtgatgagtgggggcggcgggcccgacgtggcgtggaggtggcagcaggggccagcagcggtggtgagacacggcagcctgggaacggcacccgggcaggtggcccagaggagacagccgcccagtacgcggtcatcgccatcgtccctgtcttctgcctcatggggctgttgggcatcctggtgtgcaacctcctcaagcggaagggctaccactgcacggcgcacaaggaggtcgggcccggccctggaggtggaggcagtggaatcaaccctgcctaccggactgaggatgccaatgaggacaccattggggtcctggtgcgcttgatcacagagaagaaagagaatgctgcggccctggaggagctgctgaaagagtaccacagcaaacagctggtgcagacgagccacaggcctgtgtccaagctgccgccagcgcccccgaacgtgccacacatctgcccgcaccgccaccatctccacaccgtgcagggcctggcctcgctctctggcccctgctgctcccgctgtagccagaagaagtggcccgaggtgctgctgtcccctgaggctgtagccgccactactcctgttcccagccttctgcctaacccgaccagggttcccaaggccggggccaaggcagggcgtcagggcgagatcaccatcttgtctgtgggcaggttccgcgtggctcgaattcctgagcagcggacaagttcaatggtgtctgaggtgaagaccatcacggaggctgggccctcgtggggtgatctccctgactccccacagcctggcctcccccctgagcagcaggccctgctaggaagtggcggaagccgtacaaagtggctgaagcccccagcagagaacaaggccgaggagaaccgctatgtggtccggctaagtgagagcaacctggtcatctgaggggcggtctagtctaaggacactgcggccctgccctgggaggttccgaaggcttcctggaggaggtggagctgcagctgggactgtgaggaccgagaagcaatggcccagcagacgagacagcaaagaccaaggcctggaggtgggagcgtctgccccagtgaggaggcaggtggccggcgggcactgtgtacaggagcaggctgagccccgcccctggccctgctgccatgttgctcccctgaaggatgccccgacccccgtgcctgccctggctggatcctaggagcccacgggattctctgtatcatcagaggctgggcttggcagaggggaggggcctgtgcccgtcacccctggccccattccttggtaattagccacacccttgcctctgtacagggccctagagcagatgtgcgtccccctcctcttccagcaggtctataaagggaaggggtagcagaaagtcctgggctaggagagtgagtccctgggttctaatcttgggcacatctgtggccatcgctgggtccatttttctgactgtgaagtaaggagagacgtctcagtacccagggcctcttcagctctttgtaggttctgggctgggttgtgggggactggggagctgggctctaccatccctcccattagtagctttatccagccccgtttttgctgcttccagggcctctgccttcaaggcccccatggggctgtccatccatggctctgcctacggaaggggcttaatgcatgtgcctgcccctcccccagctgtttttaatgaaactgaaaaaatagacttgatcccggcaggactgtgatacagagccctagcctgcccagccagccccaagatctcaggagctttagggagaagacttggtggggctggagcacaccttgggcctcagtggtttctgtgtccctgtggtgccagtgcttctgggcagtgcaggcggctgccaggcccagccctgacttccactctggctcagcaacctggttatttatgtggggccgtgcaggcatgggcccactgcctgtccatcctgtttctcttatttattgaaactcaccattgccctatccttgtgtctccacccccttccatgtgttgaataataaaaggtgggaaagtgaaaaaaaaaaaaaaaaaaaaagggcggccgc

SEQ ID NO: 138 - protein, 430 aa, Homo Sapiens
MKPSLLCRPLSCFLMLLPWPLATLTSTTLWQCPPGEEPDLDPGQGTLCRPCPPGTFSAAWGSSPCQPHARCSLWRRLEAQVGMATRDTLCGDCWPGWFGPWGVPRVPCQPCSWAPLGTHGCDEWGRRARRGVEVAAGASSGGETRQPGNGTRAGGPEETAAQYAVIAIVPVFCLMGLLGILVCNLLKRKGYHCTAHKEVGPGPGGGGSGINPAYRTEDANEDTIGVLVRLITEKKENAAALEELLKEYHSKQLVQTSHRPVSKLPPAPPNVPHICPHRHHLHTVQGLASLSGPCCSRCSQKKWPEVLLSPEAVAATTPVPSLLPNPTRVPKAGAKAGRQGEITILSVGRFRVARIPEQRTSSMVSEVKTITEAGPSWGDLPDSPQPGLPPEQQALLGSGGSRTKWLKPPAENKAEENRYVVRLSESNLVI

SEQ ID NO: 139 - DNA, 1290 bp, Homo Sapiens
atgaagccaagtctgctgtgccggcccctgtcctgcttccttatgctgctgccctggcctctcgccaccctgacatcaacaaccctttggcagtgcccacctggggaggagcccgacctggacccagggcagggcacattatgcaggccctgccccccaggcaccttctcagctgcatggggctccagcccatgccagccccatgcccgttgcagcctttggaggaggctggaggcccaggtgggcatggcaactcgagatacactctgtggagactgctggcctgggtggtttgggccttggggggttccccgcgttccatgtcaaccatgttcctgggcacctctgggtactcatggctgtgatgagtgggggcggcgggcccgacgtggcgtggaggtggcagcaggggccagcagcggtggtgagacacggcagcctgggaacggcacccgggcaggtggcccagaggagacagccgcccagtacgcggtcatcgccatcgtccctgtcttctgcctcatggggctgttgggcatcctggtgtgcaacctcctcaagcggaagggctaccactgcacggcgcacaaggaggtcgggcccggccctggaggtggaggcagtggaatcaaccctgcctaccggactgaggatgccaatgaggacaccattggggtcctggtgcgcttgatcacagagaagaaagagaatgctgcggccctggaggagctgctgaaagagtaccacagcaaacagctggtgcagacgagccacaggcctgtgtccaagctgccgccagcgcccccgaacgtgccacacatctgcccgcaccgccaccatctccacaccgtgcagggcctggcctcgctctctggcccctgctgctcccgctgtagccagaagaagtggcccgaggtgctgctgtcccctgaggctgtagccgccactactcctgttcccagccttctgcctaacccgaccagggttcccaaggccggggccaaggcagggcgtcagggcgagatcaccatcttgtctgtgggcaggttccgcgtggctcgaattcctgagcagcggacaagttcaatggtgtctgaggtgaagaccatcacggaggctgggccctcgtggggtgatctccctgactccccacagcctggcctcccccctgagcagcaggccctgctaggaagtggcggaagccgtacaaagtggctgaagcccccagcagagaacaaggccgaggagaaccgctatgtggtccggctaagtgagagcaacctggtcatc

SEQ ID NO: 140 - protein, 408 aa, Homo Sapiens
TLTSTTLWQCPPGEEPDLDPGQGTLCRPCPPGTFSAAWGSSPCQPHARCSLWRRLEAQVGMATRDTLCGDCWPGWFGPWGVPRVPCQPCSWAPLGTHGCDEWGRRARRGVEVAAGASSGGETRQPGNGTRAGGPEETAAQYAVIAIVPVFCLMGLLGILVCNLLKRKGYHCTAHKEVGPGPGGGGSGINPAYRTEDANEDTIGVLVRLITEKKENAAALEELLKEYHSKQLVQTSHRPVSKLPPAPPNVPHICPHRHHLHTVQGLASLSGPCCSRCSQKKWPEVLLSPEAVAATTPVPSLLPNPTRVPKAGAKAGRQGEITILSVGRFRVARIPEQRTSSMVSEVKTITEAGPSWGDLPDSPQPGLPPEQQALLGSGGSRTKWLKPPAENKAEENRYVVRLSESNLVI

SEQ ID NO: 141 - protein, 40 aa, Homo Sapiens
CPDGTYTDSWNHEQCLPCTRCEPMGQYMVQPCTWTQNTVC

SEQ ID NO: 142 - protein, 40 aa, Homo Sapiens
CPPGTFSAAWGSSPCQPHARCSLWRRLEAQVGMATRDTLC

SEQ ID NO: 143 - DNA, 29 bp, Artificial Sequence
  Oligonucleotide
ctggtggtccccggactcctacttcggtt

SEQ ID NO: 144 - DNA, 20 bp, Artificial Sequence
  Oligonucleotide
gactcctacttcggttcaga

SEQ ID NO: 145 - DNA, 5042 bp, Homo Sapiens
  CDS (127)...(3690)
gtcgacccacgcgtccgggcgccccgcgcagtgcaggctgcaggcgccgcgccgaggaggctgccgctctggcttgccgccccccgccgccgctgcacaccggacccagccgccgtgccgcgggccatggacctgcccaggggcctggtggtggcctgggcgctcagcctgtggccagggttcacggacaccttcaacatggacaccaggaagccccgggtcatccctggctccaggaccgccttctttggctacacagtgcagcagcacgacatcagtggcaataagtggctggtcgtgggcgccccactggaaaccaatggctaccagaagacgggagacgtgtacaagtgtccagtgatccacgggaactgcaccaaactcaacctgggaagggtcaccctgtccaacgtgtccgagcggaaagacaacatgcgcctcggccttagtctcgccaccaaccccaaggacaacagcttcctggcctgcagccccctctggtctcatgagtgtgggagctcctactacaccacagggatgtgttcaagagtcaactccaacttcaggttctccaagaccgtggccccagctctccaaaggtgccagacctacatggacatcgtcattgtcctggatggctccaacagcatctacccctgggtggaggttcagcacttcctcatcaacatcctgaaaaagttttacattggcccagggcagatccaggttggagttgtgcagtatggcgaagatgtggtgcatgagtttcacctcaacgactacaggtctgtaaaagatgtggtggaagctgccagccacattgagcagagaggaggaacagagacccggacggcatttggcattgaatttgcacgctcagaggctttccagaagggtggaaggaaaggagccaagaaggtgatgattgtcatcacagatggggagtcccacgacagcccagacctggagaaggtgatccagcaaagcgaaagagacaacgtaacaagatatgcggtggccgtcctgggctactacaaccgcagggggatcaatccagaaacttttctaaatgaaatcaaatacatcgccagtgaccctgatgacaagcacttcttcaatgtcactgatgaggctgccttgaaggacattgtcgatgccctgggggacagaatcttcagcctggaaggcaccaacaagaacgagacctcctttgggctggagatgtcacagacgggcttttcctcgcacgtggtggaggatggggttctgctgggagccgtcggtgcctatgactggaatggagctgtgctaaaggagacgagtgccgggaaggtcattcctctccgcgagtcctacctgaaagagttccccgaggagctcaagaaccatggtgcatacctggggtacacagtcacatcggtcgtgtcctccaggcaggggcgagtgtacgtggccggagccccccggttcaaccacacgggcaaggtcatcctgttcaccatgcacaacaaccggagcctcaccatccaccaggctatgcggggccagcagataggctcttactttgggagtgaaatcacctcggtggacatcgacggcgacggcgtgactgatgtcctgctggtgggcgcacccatgtacttcaacgagggccgtgagcgaggcaaggtgtacgtctatgagctgagacagaaccggtttgtttataacggaacgctaaaggattcacacagttaccagaatgcccgatttgggtcctccattgcctcagttcgagacctcaaccaggattcctacaatgacgtggtggtgggagcccccctggaggacaaccacgcaggagccatctacatcttccacggcttccgaggcagcatcctgaagacacctaagcagagaatcacagcctcagagctggctaccggcctccagtattttggctgcagcatccacgggcaattggacctcaatgaggatgggctcatcgacctggcagtgggagcccttggcaacgctgtgattctgtggtcccgcccagtggttcagatcaatgccagcctccactttgagccatccaagatcaacatcttccacagagactgcaagcgcagtggcagggatgccacctgcctggccgccttcctctgcttcacgcccatcttcctggcaccccatttccaaacaacaactgttggcatcagatacaacgccaccatggatgagaggcggtatacaccgagggcccacctggacgagggcggggaccgattcaccaacagagccgtactgctctcctccggccaggagctctgtgagcggatcaacttccatgtcctggacactgctgactacgtgaagccagtgaccttctcagtcgagtattccctggaggaccctgaccatggccccatgctggacgacggctggcccaccactctcagagtctcggtgcccttctggaacggctgcaatgaggatgagcactgtgtccctgaccttgtgttggatgcccggagtgacctgcccacggccatggagtactgccagagggtgctgaggaagcctgcgcaggactgctccgcatacacgctgtccttcgacaccacagtcttcatcatagagagcacacgccagcgagtggcggtggaggccacactggagaacaggggcgagaacgcctacagcacggtcctaaatatctcgcagtcagcaaacctgcagtttgccagcttgatccagaaggaggactcagacggtagcattgagtgtgtgaacgaggagaggaggctccagaagcaagtctgcaacgtcagctatcccttcttccgggccaaggccaaggtggctttccgtcttgattttgagttcagcaaatccatcttcctacaccacctggagatcgagctcgctgcaggcagtgacagtaatgagcgggacagcaccaaggaagacaacgtggcccccttacgcttccacctcaaatacgaggctgacgtcctcttcaccaggagcagcagcctgagccactacgaggtcaagcccaacagctcgctggagagatacgatggtatcgggcctcccttcagctgcatcttcaggatccagaacttgggcttgttccccatccacgggatgatgatgaagatcaccattcccatcgccaccaggagcggcaaccgcctactgaagctgagggacttcctcacggacgaggcgaacacgtcctgtaacatctggggcaatagcactgagtaccggcccaccccagtggaggaagacttgcgtcgtgctccacagctgaatcacagcaactctgatgtcgtctccatcaactgcaatatacggctggtccccaaccaggaaatcaatttccatctactggggaacctgtggttgaggtccctaaaagcactcaagtacaaatccatgaaaatcatggtcaacgcagccttgcagaggcagttccacagccccttcatcttccgtgaggaggatcccagccgccagatcgtgtttgagatctccaagcaagaggactggcaggtccccatctggatcattgtaggcagcaccctggggggcctcctactgctggccctgctggtcctggcactgtggaagctcggcttctttagaagtgccaggcgcaggagggagcctggtctggaccccacccccaaagtgctggagtgaggctccagaggagactttgagttgatgggggccaggacaccagtccaggtagtgttgagacccaggcctgtggccccaccgagctggagcggagaggaagccagctggctttgcacttgacctcatctcccgagcaatggcgcctgctccctccagaatggaactcaagctggttttaagtggaactgccctactgggagactgggacacctttaacacagacccctagggatttaaagggacacccctacacacacccaggcccacgccaaggcctccctcaggctctgtggagggcatttgctgccccagctactaaggtgctaggaattcgtaatcatccccatcctccagagaaacccagggaggaagactgtaaatacgaacccaatctgcacactccaggcctctagttccagaaggatccaagacaaaacagatctgaattctgcccttttctctcacccatcccacccctccattggctcccaagtcacacccactcccttccccatagataggcccctggggctcctgaagaatgaacccaagagcaagggcttgatggtgacagctgcaagccagggatgaagaaagactctgagatgtggagactgatggccaggcaagtgggaccaggatactggacgctgtcctgagatgagaggtagccgggctctgcacccacgtgcattcacattgaccgcaactcacacattcccccaccagctgcagccccttgctctcagctgccaaccctcccgggtcacttttgttcccaggtacctcatgggaagcatgtggatgacacaatccctggggctgtgcattcccacgtcttcttgctgcagcctgcccctagacatggacgcactggcctggctgcagctgggcagcaggggtaggggtagggagcctcccctccctgtatcaccccctccctacacacacacacacacacacacacacacactgcctcccatccttccctcatgcccgccagtgcacagggaagggcttggccagcgctgttgaggggtcccctctggaatgcactgaataaagcacgtgcaaggactcccggagcctgtgcagccttggtggcaaatatctcatctgccggcccccaggacaagtggtatgaccagtgataatgccccaaggacaaggggcgtgcctggcgcccagtggagtaatttatgccttagtcttgttttgaggtagaaatgcaagggggacacatgaaaggcatcagtccccctgtgcatagtacgacctttactgtcgtatttttgaaaaattaaaaatacagtgtttaaaaacaaaaaaaaaaaaaaaagggcggccgc

SEQ ID NO: 146 - DNA, 3564 bp, Homo Sapiens
  CDS (1)...(3564)
atggacctgcccaggggcctggtggtggcctgggcgctcagcctgtggccagggttcacggacaccttcaacatggacaccaggaagccccgggtcatccctggctccaggaccgccttctttggctacacagtgcagcagcacgacatcagtggcaataagtggctggtcgtgggcgccccactggaaaccaatggctaccagaagacgggagacgtgtacaagtgtccagtgatccacgggaactgcaccaaactcaacctgggaagggtcaccctgtccaacgtgtccgagcggaaagacaacatgcgcctcggccttagtctcgccaccaaccccaaggacaacagcttcctggcctgcagccccctctggtctcatgagtgtgggagctcctactacaccacagggatgtgttcaagagtcaactccaacttcaggttctccaagaccgtggccccagctctccaaaggtgccagacctacatggacatcgtcattgtcctggatggctccaacagcatctacccctgggtggaggttcagcacttcctcatcaacatcctgaaaaagttttacattggcccagggcagatccaggttggagttgtgcagtatggcgaagatgtggtgcatgagtttcacctcaacgactacaggtctgtaaaagatgtggtggaagctgccagccacattgagcagagaggaggaacagagacccggacggcatttggcattgaatttgcacgctcagaggctttccagaagggtggaaggaaaggagccaagaaggtgatgattgtcatcacagatggggagtcccacgacagcccagacctggagaaggtgatccagcaaagcgaaagagacaacgtaacaagatatgcggtggccgtcctgggctactacaaccgcagggggatcaatccagaaacttttctaaatgaaatcaaatacatcgccagtgaccctgatgacaagcacttcttcaatgtcactgatgaggctgccttgaaggacattgtcgatgccctgggggacagaatcttcagcctggaaggcaccaacaagaacgagacctcctttgggctggagatgtcacagacgggcttttcctcgcacgtggtggaggatggggttctgctgggagccgtcggtgcctatgactggaatggagctgtgctaaaggagacgagtgccgggaaggtcattcctctccgcgagtcctacctgaaagagttccccgaggagctcaagaaccatggtgcatacctggggtacacagtcacatcggtcgtgtcctccaggcaggggcgagtgtacgtggccggagccccccggttcaaccacacgggcaaggtcatcctgttcaccatgcacaacaaccggagcctcaccatccaccaggctatgcggggccagcagataggctcttactttgggagtgaaatcacctcggtggacatcgacggcgacggcgtgactgatgtcctgctggtgggcgcacccatgtacttcaacgagggccgtgagcgaggcaaggtgtacgtctatgagctgagacagaaccggtttgtttataacggaacgctaaaggattcacacagttaccagaatgcccgatttgggtcctccattgcctcagttcgagacctcaaccaggattcctacaatgacgtggtggtgggagcccccctggaggacaaccacgcaggagccatctacatcttccacggcttccgaggcagcatcctgaagacacctaagcagagaatcacagcctcagagctggctaccggcctccagtattttggctgcagcatccacgggcaattggacctcaatgaggatgggctcatcgacctggcagtgggagcccttggcaacgctgtgattctgtggtcccgcccagtggttcagatcaatgccagcctccactttgagccatccaagatcaacatcttccacagagactgcaagcgcagtggcagggatgccacctgcctggccgccttcctctgcttcacgcccatcttcctggcaccccatttccaaacaacaactgttggcatcagatacaacgccaccatggatgagaggcggtatacaccgagggcccacctggacgagggcggggaccgattcaccaacagagccgtactgctctcctccggccaggagctctgtgagcggatcaacttccatgtcctggacactgctgactacgtgaagccagtgaccttctcagtcgagtattccctggaggaccctgaccatggccccatgctggacgacggctggcccaccactctcagagtctcggtgcccttctggaacggctgcaatgaggatgagcactgtgtccctgaccttgtgttggatgcccggagtgacctgcccacggccatggagtactgccagagggtgctgaggaagcctgcgcaggactgctccgcatacacgctgtccttcgacaccacagtcttcatcatagagagcacacgccagcgagtggcggtggaggccacactggagaacaggggcgagaacgcctacagcacggtcctaaatatctcgcagtcagcaaacctgcagtttgccagcttgatccagaaggaggactcagacggtagcattgagtgtgtgaacgaggagaggaggctccagaagcaagtctgcaacgtcagctatcccttcttccgggccaaggccaaggtggctttccgtcttgattttgagttcagcaaatccatcttcctacaccacctggagatcgagctcgctgcaggcagtgacagtaatgagcgggacagcaccaaggaagacaacgtggcccccttacgcttccacctcaaatacgaggctgacgtcctcttcaccaggagcagcagcctgagccactacgaggtcaagcccaacagctcgctggagagatacgatggtatcgggcctcccttcagctgcatcttcaggatccagaacttgggcttgttccccatccacgggatgatgatgaagatcaccattcccatcgccaccaggagcggcaaccgcctactgaagctgagggacttcctcacggacgaggcgaacacgtcctgtaacatctggggcaatagcactgagtaccggcccaccccagtggaggaagacttgcgtcgtgctccacagctgaatcacagcaactctgatgtcgtctccatcaactgcaatatacggctggtccccaaccaggaaatcaatttccatctactggggaacctgtggttgaggtccctaaaagcactcaagtacaaatccatgaaaatcatggtcaacgcagccttgcagaggcagttccacagccccttcatcttccgtgaggaggatcccagccgccagatcgtgtttgagatctccaagcaagaggactggcaggtccccatctggatcattgtaggcagcaccctggggggcctcctactgctggccctgctggtcctggcactgtggaagctcggcttctttagaagtgccaggcgcaggagggagcctggtctggaccccacccccaaagtgctggag

SEQ ID NO: 147 - protein, 1188 aa, Homo Sapiens [sequence omitted]

SEQ ID NO: 148 - protein, 1166 aa, Homo Sapiens
FNMDTRKPRVIPGSRTAFFGYTVQQHDISGNKWLVVGAPLETNGYQKTGDVYKCPVIHGNCTKLNLGRVTLSNVSERKDNMRLGLSLATNPKDNSFLACSPLWSHECGSSYYTTGMCSRVNSNFRFSKTVAPALQRCQTYMDIVIVLDGSNSIYPWVEVQHFLINILKKFYIGPGQIQVGVVQYGEDVVHEFHLNDYRSVKDVVEAASHIEQRGGTETRTAFGIEFARSEAFQKGGRKGAKKVMIVITDGESHDSPDLEKVIQQSERDNVTRYAVAVLGYYNRRGINPETFLNEIKYIASDPDDKHFFNVTDEAALKDIVDALGDRIFSLEGTNKNETSFGLEMSQTGFSSHVVEDGVLLGAVGAYDWNGAVLKETSAGKVIPLRESYLKEFPEELKNHGAYLGYTVTSVVSSRQGRVYVAGAPRFNHTGKVILFTMHNNRSLTIHQAMRGQQIGSYFGSEITSVDIDGDGVTDVLLVGAPMYFNEGRERGKVYVYELRQNRFVYNGTLKDSHSYQNARFGSSIASVRDLNQDSYNDVVVGAPLEDNHAGAIYIFHGFRGSILKTPKQRITASELATGLQYFGCSIHGQLDLNEDGLIDLAVGALGNAVILWSRPVVQINASLHFEPSKINIFHRDCKRSGRDATCLAAFLCFTPIFLAPHFQTTTVGIRYNATMDERRYTPRAHLDEGGDRFTNRAVLLSSGQELCERINFHVLDTADYVKPVTFSVEYSLEDPDHGPMLDDGWPTTLRVSVPFWNGCNEDEHCVPDLVLDARSDLPTAMEYCQRVLRKPAQDCSAYTLSFDTTVFIIESTRQRVAVEATLENRGENAYSTVLNISQSANLQFASLIQKEDSDGSIECVNEERRLQKQVCNVSYPFFRAKAKVAFRLDFEFSKSIFLHHLEIELAAGSDSNERDSTKEDNVAPLRFHLKYEADVLFTRSSSLSHYEVKPNSSLERYDGIGPPFSCIFRIQNLGLFPIHGMMMKITIPIATRSGNRLLKLRDFLTDEANTSCNIWGNSTEYRPTPVEEDLRRAPQLNHSNSDVVSINCNIRLVPNQEINFHLLGNLWLRSLKALKYKSMKIMVNAALQRQFHSPFIFREEDPSRQIVFEISKQEDWQVPIWIIVGSTLGGLLLLALLVLALWKLGFFRSARRRREPGLDPTPKVLE

SEQ ID NO: 149 - protein, 22 aa, Homo Sapiens
  SIGNAL (1)...(22)
MDLPRGLVVAWALSLWPGFTDT

SEQ ID NO: 150 - protein, 1141 aa, Homo Sapiens
  SIGNAL (1)...(22)
MDLPRGLVVAWALSLWPGFTDTFNMDTRKPRVIPGSRTAFFGYTVQQHDISGNKWLVVGAPLETNGYQKTGDVYKCPVIHGNCTKLNLGRVTLSNVSERKDNMRLGLSLATNPKDNSFLACSPLWSHECGSSYYTTGMCSRVNSNFRFSKTVAPALQRCQTYMDIVIVLDGSNSIYPWVEVQHFLINILKKFYIGPGQIQVGVVQYGEDVVHEFHLNDYRSVKDVVEAASHIEQRGGTETRTAFGIEFARSEAFQKGGRKGAKKVMIVITDGESHDSPDLEKVIQQSERDNVTRYAVAVLGYYNRRGINPETFLNEIKYIASDPDDKHFFNVTDEAALKDIVDALGDRIFSLEGTNKNETSFGLEMSQTGFSSHVVEDGVLLGAVGAYDWNGAVLKETSAGKVIPLRESYLKEFPEELKNHGAYLGYTVTSVVSSRQGRVYVAGAPRFNHTGKVILFTMHNNRSLTIHQAMRGQQIGSYFGSEITSVDIDGDGVTDVLLVGAPMYFNEGRERGKVYVYELRQNRFVYNGTLKDSHSYQNARFGSSIASVRDLNQDSYNDVVVGAPLEDNHAGAIYIFHGFRGSILKTPKQRITASELATGLQYFGCSIHGQLDLNEDGLIDLAVGALGNAVILWSRPVVQINASLHFEPSKINIFHRDCKRSGRDATCLAAFLCFTPIFLAPHFQTTTVGIRYNATMDERRYTPRAHLDEGGDRFTNRAVLLSSGQELCERINFHVLDTADYVKPVTFSVEYSLEDPDHGPMLDDGWPTTLRVSVPFWNGCNEDEHCVPDLVLDARSDLPTAMEYCQRVLRKPAQDCSAYTLSFDTTVFIIESTRQRVAVEATLENRGENAYSTVLNISQSANLQFASLIQKEDSDGSIECVNEERRLQKQVCNVSYPFFRAKAKVAFRLDFEFSKSIFLHHLEIELAAGSDSNERDSTKEDNVAPLRFHLKYEADVLFTRSSSLSHYEVKPNSSLERYDGIGPPFSCIFRIQNLGLFPIHGMMMKITIPIATRSGNRLLKLRDFLTDEANTSCNIWGNSTEYRPTPVEEDLRRAPQLNHSNSDVVSINCNIRLVPNQEINFHLLGNLWLRSLKALKYKSMKIMVNAALQRQFHSPFIFREEDPSRQIVFEISKQEDWQVP

SEQ ID NO: 151 - protein, 182 aa, Homo Sapiens
DIVIVLDGSNSIYPWVEVQHFLINILKKFYIGPGQIQVGVVQYGEDVVHEFHLNDYRSVKDVVEAASHIEQRGGTETRTAFGIEFARSEAFQKGGRKGAKKVMIVITDGESHDSPDLEKVIQQSERDNVTRYAVAVLGYYNRRGINPETFLNEIKYIASDPDDKHFFNVTDEAALKDIVDAL

SEQ ID NO: 152 - protein, 36 aa, Homo Sapiens
AFFGYTVQQHDISGNKWLVVGAPLETNGYQKTGDVY

SEQ ID NO: 153 - protein, 43 aa, Homo Sapiens
DNSFLACSPLWSHECGSSYYTTGMCSRVNSNFRFSKTVAPALQ

SEQ ID NO: 154 - protein, 26 aa, Homo Sapiens
SQTGFSSHVVEDGVLLGAVGAYDWNG

SEQ ID NO: 155 - protein, 35 aa, Homo Sapiens
HGAYLGYTVTSVVSSRQGRVYVAGAPRFNHTGKVI

SEQ ID NO: 156 - protein, 39 aa, Homo Sapiens
SYFGSEITSVDIDGDGVTDVLLVGAPMYFNEGRERGKVY

SEQ ID NO: 157 - protein, 36 aa, Homo Sapiens
ARFGSSIASVRDLNQDSYNDVVVGAPLEDNHAGAIY

SEQ ID NO: 158 - protein, 39 aa, Homo Sapiens
QYFGCSIHGQLDLNEDGLIDLAVGALGNAVILWSRPVVQ

SEQ ID NO: 159 - protein, 23 aa, Homo Sapiens
IWIIVGSTLGGLLLLALLVLALW

SEQ ID NO: 160 - protein, 24 aa, Homo Sapiens
KLGFFRSARRRREPGLDPTPKVLE

SEQ ID NO: 161 - DNA, 3884 bp, Homo Sapiens
  CDS (22)...(3522)
caggtcagaaaccgatcaggcatggaactccccttcgtcactcacctgttcttgcccctggtgttcctgacaggtctctgctccccctttaacctggatgaacatcacccacgcctattcccagggccaccagaagctgaatttggatacagtgtcttacaacatgttgggggtggacagcgatggatgctggtgggcgccccctgggatgggccttcaggcgaccggaggggggacgtttatcgctgccctgtagggggggcccacaatgccccatgtgccaagggccacttaggtgactaccaactgggaaattcatctcatcctgctgtgaatatgcacctggggatgtctctgttagagacagatggtgatgggggattcatggcctgtgcccctctctggtctcgtgcttgtggcagctctgtcttcagttctgggatatgtgcccgtgtggatgcttcattccagcctcagggaagcctggcacccactgcccaacgctgcccaacatacatggatgttgtcattgtcttggatggctccaacagcatctacccctggtctgaagttcagaccttcctacgaagactggtagggaaactgtttattgacccagaacagatacaggtgggactggtacagtatggggagagccctgtacatgagtggtccctgggagatttccgaacgaaggaagaagtggtgagagcagcaaagaacctcagtcggcgggagggacgagaaacaaagactgcccaagcaataatggtggcctgcacagaagggttcagtcagtcccatgggggccgacccgaggctgccaggctactggtggttgtcactgatggagagtcccatgatggagaggagcttcctgcagcactaaaggcctgtgaggctggaagagtgacacgctatgggattgcagtccttggtcactacctccggcggcagcgagatcccagctctttcctgagagaaattagaactattgccagtgatccagatgagcgattcttcttcaatgtcacagatgaggctgctctgactgacattgtggatgcactaggagatcggatttttggccttgaagggtcccatgcagaaaacgaaagctcctttgggctggaaatgtctcagattggtttctccactcatcggctaaaggatgggattctttttgggatggtgggggcctatgactggggaggctctgtgctatggcttgaaggaggccaccgccttttccccccacgaatggcactggaagacgagttcccccctgcactgcagaaccatgcagcctacctgggttactctgtttcttccatgcttttgcggggtggacgccgcctgtttctctctggggctcctcgatttagacatcgaggaaaagtcatcgccttccagcttaagaaagatggggctgtgagggttgcccagagcctccagggggagcagattggttcatactttggcagtgagctctgcccattggatacagatagggatggaacaactgatgtcttacttgtggctgcccccatgttcctgggaccccagaacaaggaaacaggacgtgtttatgtgtatctggtaggccagcagtccttgctgaccctccaaggaacacttcagccagaacccccccaggatgctcggtttggctttgccatgggagctcttcctgatctgaaccaagatggttttgctgatgtggctgtgggggcgcctctggaagatgggcaccagggagcactgtacctgtaccatggaacccagagtggagtcaggccccatcctgcccagaggattgctgctgcctccatgccacatgccctcagctactttggccgaagtgtggatggtcggctagatctggatggagatgatctggtcgatgtggctgtgggtgcccagggggcagccatcctgctcagctcccggcccattgtccatctgaccccatcactggaggtgaccccacaggccatcagtgtggttcagagggactgtaggcggcgaggccaagaagcagtctgtctgactgcagccctttgcttccaagtgacctcccgtactcctggtcgctgggatcaccaattctacatgaggttcaccgcatcactggatgaatggactgctggggcacgtgcagcatttgatggctctggccagaggttgtcccctcggaggctccggctcagtgtggggaatgtcacttgtgagcagctacacttccatgtgctggatacatcagattacctccggccagtggccttgactgtgacctttgccttggacaatactacaaagccagggcctgtgctgaatgagggctcacccacctctatacaaaagctggtccccttctcaaaggattgtggccctgacaatgaatgtgtcacagacctggtgcttcaagtgaatatggacatcagaggctccaggaaggccccatttgtggttcgaggtggccggcggaaagtgctggtatctacaactctggagaacagaaaggaaaatgcttacaatacgagcctgagtatcatcttctctagaaacctccacctggccagtctcactcctcagagagagagcccaataaaggtggaatgtgccgccccttctgctcatgcccggctctgcagtgtggggcatcctgtcttccagactggagccaaggtgacctttctgctagagtttgagtttagctgctcctctctcctgagccaggtctttgggaagctgactgccagcagtgacagcctggagagaaatggcacccttcaagaaaacacagcccagacctcagcctacatccaatatgagccccacctcctgttctctagtgagtctaccctgcaccgctatgaggttcacccatatgggaccctcccagtgggtcctggcccagaattcaaaaccactctcagggttcagaacctaggctgctatgtggtcagtggcctcatcatctcagccctccttccagctgtggcccatgggggcaattacttcctatcactgtctcaagtcatcactaacaatgcaagctgcatagtgcagaacctgactgaacccccaggcccacctgtgcatccagaggagcttcaacacacaaacagactgaatgggagcaatactcagtgtcaggtggtgaggtgccaccttgggcagctggcaaaggggactgaggtctctgttggactattgaggctggttcacaatgaatttttccgaagagccaagttcaagtccctgacggtggtcagcacctttgagctgggaaccgaagagggcagtgtcctacagctgactgaagcctcccgttggagtgagagcctcttggaggtggttcagacccggcctatcctcatctccctgtggatcctcataggcagtgtcctgggagggttgctcctgcttgctctccttgtcttctgcctgtggaagcttggcttctttgcccataagaaaatccctgaggaagaaaaaagagaagagaagttggagcaatgaatgtagaataagggtctagaaagtcctccctggcagctttcttcaagagacttgcataaaagcagaggtttgggggctcagatgggacaagaagccgcctctggactatctccccagaccagcagcctgacttgacttttgagtcctagggatgctgctggctagagatgaggctttacctcagacaagaagagctggcaccaaaactagccatgctcccaccctctgcttccctcctcctcgtgatcctggttccatagccaacactggggcttttgtttggggtccttttatccccaggaatcaataatttttttgcctaggaaaaaaaaaagcggccgcgaattcgatatcaagct

SEQ ID NO: 162 - protein, 1167 aa, Homo Sapiens
MELPFVTHLFLPLVFLTGLCSPFNLDEHHPRLFPGPPEAEFGYSVLQHVGGGQRWMLVGAPWDGPSGDRRGDVYRCPVGGAHNAPCAKGHLGDYQLGNSSHPAVNMHLGMSLLETDGDGGFMACAPLWSRACGSSVFSSGICARVDASFQPQGSLAPTAQRCPTYMDVVIVLDGSNSIYPWSEVQTFLRRLVGKLFIDPEQIQVGLVQYGESPVHEWSLGDFRTKEEVVRAAKNLSRREGRETKTAQAIMVACTEGFSQSHGGRPEAARLLVVVTDGESHDGEELPAALKACEAGRVTRYGIAVLGHYLRRQRDPSSFLREIRTIASDPDERFFFNVTDEAALTDIVDALGDRIFGLEGSHAENESSFGLEMSQIGFSTHRLKDGILFGMVGAYDWGGSVLWLEGGHRLFPPRMALEDEFPPALQNHAAYLGYSVSSMLLRGGRRLFLSGAPRFRHRGKVIAFQLKKDGAVRVAQSLQGEQIGSYFGSELCPLDTDRDGTTDVLLVAAPMFLGPQNKETGRVYVYLVGQQSLLTLQGTLQPEPPQDARFGFAMGALPDLNQDGFADVAVGAPLEDGHQGALYLYHGTQSGVRPHPAQRIAAASMPHALSYFGRSVDGRLDLDGDDLVDVAVGAQGAAILLSSRPIVHLTPSLEVTPQAISVVQRDCRRRGQEAVCLTAALCFQVTSRTPGRWDHQFYMRFTASLDEWTAGARAAFDGSGQRLSPRRLRLSVGNVTCEQLHFHVLDTSDYLRPVALTVTFALDNTTKPGPVLNEGSPTSIQKLVPFSKDCGPDNECVTDLVLQVNMDIRGSRKAPFVVRGGRRKVLVSTTLENRKENAYNTSLSIIFSRNLHLASLTPQRESPIKVECAAPSAHARLCSVGHPVFQTGAKVTFLLEFEFSCSSLLSQVFGKLTASSDSLERNGTLQENTAQTSAYIQYEPHLLFSSESTLHRYEVHPYGTLPVGPGPEFKTTLRVQNLGCYVVSGLIISALLPAVAHGGNYFLSLSQVITNNASCIVQNLTEPPGPPVHPEELQHTNRLNGSNTQCQVVRCHLGQLAKGTEVSVGLLRLVHNEFFRRAKFKSLTVVSTFELGTEEGSVLQLTEASRWSESLLEVVQTRPILISLWILIGSVLGGLLLLALLVFCLWKLGFFAHKKIPEEEKREEKLEQ

SEQ ID NO: 163 - DNA, 4858 bp, Mus Musculus
  CDS (28)...(3591)
gcgacacccgccgccgcgcagcgggccatggactttcccaggggcctcctggtggcctggaccctcagcctttggccaggattcacggacaccttcaatatggataccagaaatccccgggtcattgctggtcccagtgctgccttctttggctacacagtacagcagcatgatatcagtggcaagaagtggttggttgtgggtgccccaatggaaaccaatggccatcagaagacaggagacgtatacaaatgtccggtaacccagggcaactgcaccaagctcaacctgggcagggtcactctgtccaatgtgtctgagaggaaggacaacatgcgcctcggcctgagccttgccaccaaccccaaggacaacagcttcctggcctgcagccctctctggtcgcacgagtgtggaagctcctactacaccactggcatgtgctcacgggtcaactccaacttcagattctctaagacggtagctccggcacttcagaggtgccagacttacatggacatcgtcattgtcttagatggctccaacagcatctacccctgggtggaggtccaacacttcctcatcaatatcctcaaaaagttctacattggccccggccagatccaggtcggaatagtccagtatggagaagatgccgtccatgagttccaccttaatgactacaggtctgtaaaagatgtggtggaagccgccagccacattgagcagagaggagggacagagacccgcacggcatttggcattgaatttgcacgctcggaggctttccagaagggtggaagaaaaggggccaagaaagtgatgattgtcatcacggacggggaatcccacgacagcccagacctggagaaggtgatccggcagagcgagaaggacaacgtgaccagatacgctgtggccgttttgggctactacaaccgcagggggatcaatccagagacttttctaaatgaaatcaaatacatcgccagcgaccctgacgacaagcacttcttcaacgtcacagatgaggcggccctgaaggacattgttgatgcccttggggacaggatcttcagcttggaaggcaccaacaagaatgagacctcttttgggctggagatgtcgcagactggcttttcttcacatgtggtagaggatgggatcctgctgggagctgtgggagcctatgactggaacggggcggtgctgaaggagacaagtgctggcaaggtgattcctcaccgagagtcctaccttaaggagtttccagaggagctgaagaaccatgcagcatacctagggtacacggtgacgtcggttgtgtcctccaggcaggggcgggtgtatgtggctggagcccccagattcaaccatactggcaaggtcattctattcagcatgcacaacaaccggagcctcaccatccaccaggctcttcggggcgagcagataggctcctactttgggagtgagattacctcagtggacgtcaatgatgacagagtgacagatgtgctgctggtgggtgcacccatgtacttcagcgagggccgagagcgaggcaaggtgtatgtctacaacctgagacagaaccggtttgtttataatggcactctgaaggattcccacagctaccagaacgcccggttcgggtcctgcatcgcctctgttcaagacctcaaccaagattcctacaatgatgtggtggtgggggcccctctggaggacagccacagaggggccatctacatcttccatggcttccaaaccaatatcctgaagaagcccatgcagagaataacagcctcggagctggctcctggcctgcagcattttggctgcagcatccacggacaactggacctcaatgaggatgggcttgtggacctagcagtgggcgccctgggcaacgctgtggttttgtgggcccgccctgtagttcaaatcaacgccagcctccactttgagccttccaagatcaacatcttccacaaggactgcaagcgcaatggcagggatgccacctgcctggccgccttcctctgcttcatacccatcttcctggcaccccacttccaaacagcaaccgtcggcatcaggtacaatgcaaccatggatgagaggcggtatatgccgcgggcacatctggacgagggcggagaccagttcaccaacagagccgtcctgctctcctctggccaggaacactgtcaaaggatcaacttccatgtcctggacactgcagactacgtgaagccagtggccttctccgtggagtactccctagaggaccctgacaacggccccatgctggacaacggctggcccactacgctcagagtgtcggtgcccttctggaatggctgtaatgaggatgaacactgtgtccctgaccttgtactggatgctcggagtgacctgcccactgccatggagtactgccagcgggtgctggggaggccggcgcaggactgctccagctacaccctgtccttcgacaccactgtcttcatcatagagagcacgcgccgccgggtggcagtggaggccacgctggagaacagaggagagaatgcttacagcgccgtcctcaacatctcccagtcagagaaccttcagtttgccagcctgatccagaaggatgactcagacaacagcatcgagtgtgtgaacgaggagaggcggcttcacaagaaagtctgcaacgtcagctaccccttcttcagagccaaggccaaggtggctttccgtctggatttcgagttcagcaagtctgtgtttctgcaccatcttcagatccatctgggtgccggcagtgacagtcacgagcaagacagcaccgcagacgataacacggccctcctgcgcttccacctcaaatatgaagcagacgtcctctttaccagaagcagcagcctgagccacttcgaggtcaaggcaaacagctcacttgagagctatgatggcatcggacctccgttcaactgtgttttcaaggtgcagaacctgggctttttccccatccacggggtgatgatgaagatcactgtgcccatcgccaccaggggtggcaaccgcctgctgatgttgagggacttcttcaccgaccagggcaacacatcctgtaacatctgggggaacagcacagagtacaggagtaccccaactgaggaagatctgagccatgccccacagaggaatcacagcaactccgacgtggtctccatcatctgcaacctgaggctggcccccagccaggagaccagcttctacctggtgggaaacctgtggctgacatctctgaaagcactcaagtacaggtctctgaagatcacagtcaacgccgccttgcagaggcagttccacagccccttcatcttccgagaggaagaccctagccgccaggtcacatttgagatctccaagcaagaagactggcaggtccccatctggatcatcgtgggcagcactctggggggcctcttgctgctggccctgctggtcctggcactgtggaagctcggtttttttaaaagtgccaagcgcaagagggaacctggcctaggccccatccccaaagagctcaagtgaggatccagaggaagcttcaagttgttgggggcccgacaccagtccgggggtgtgcaggcccgggctatggcctcagagctggagcaaagaggacacccatggactttacattgagttcatctctggagcaatggcaactgatcgctgtgggatggacctccagcccgtgttcggagtgacttctctactagaggccaagacctccagtacagatccctaaggactaaaagggaccctccaagacccaccggtggccttcccccaaggctctgtggagggaatctgctgccccaaacactaaggtgctagggttttgttgtcttgcccacctctgaagaaactcaaggggaagctagcaaatacgagcccactgtgcacgccctatctggacctatagcttcaggactccatggcccgggagcataacctccgccgcaccccttacccttgctcttggttcccaaaccacagccatcccttctccacagatagaccccaaagatctctatgagtgacccagagttgtgtggcttgatatgccagctgcaggccagtgatggaaacacatccagggactgtgccaaatgaactggagggaatcaggatgctgggtaccttccaaacatcagaaagcagcagggctctccagcagtaaccaccacccactcaatcctgctctccagcctcccccgcagctcctctcagccgctttggttgctaggcaactcgtgctagggagcctgaggaggatgataaaaatccgtggctctccgtaccctcttgtctgacaactgcagcttgtccctggtagatgcactgtgatagggagcctctgtttcttacatcagcacctacacacacacacacacacacacacacacacacacacacacacacacacacgcacgcacctcccaaccatcagcgtgtgggagaagggctcctgtagggggcgctgtggggggccttctaggcatgcactgaacaaagcccatgcaaggcccctgggaaccttaaacctcagaggcagataggcatctcgccggccagctctgggataagccccaaggacaaggggcatgccggatgcccagcagagtaatttatgccttaaccttttgttgagatggaaatggacacatcagtgtcccctgtcatctgtttcatctgaacaatgtcatctgttcccctatgcggtacgacctttactgtcagaaatatatttaagaaaatgttctaaaaaaaaaaaaaaaagggcggccgc

SEQ ID NO: 164 - DNA, 3564 bp, Mus Musculus
  CDS (1)...(3564)
atggactttcccaggggcctcctggtggcctggaccctcagcctttggccaggattcacggacaccttcaatatggataccagaaatccccgggtcattgctggtcccagtgctgccttctttggctacacagtacagcagcatgatatcagtggcaagaagtggttggttgtgggtgccccaatggaaaccaatggccatcagaagacaggagacgtatacaaatgtccggtaacccagggcaactgcaccaagctcaacctgggcagggtcactctgtccaatgtgtctgagaggaaggacaacatgcgcctcggcctgagccttgccaccaaccccaaggacaacagcttcctggcctgcagccctctctggtcgcacgagtgtggaagctcctactacaccactggcatgtgctcacgggtcaactccaacttcagattctctaagacggtagctccggcacttcagaggtgccagacttacatggacatcgtcattgtcttagatggctccaacagcatctacccctgggtggaggtccaacacttcctcatcaatatcctcaaaaagttctacattggccccggccagatccaggtcggaatagtccagtatggagaagatgccgtccatgagttccaccttaatgactacaggtctgtaaaagatgtggtggaagccgccagccacattgagcagagaggagggacagagacccgcacggcatttggcattgaatttgcacgctcggaggctttccagaagggtggaagaaaaggggccaagaaagtgatgattgtcatcacggacggggaatcccacgacagcccagacctggagaaggtgatccggcagagcgagaaggacaacgtgaccagatacgctgtggccgttttgggctactacaaccgcagggggatcaatccagagacttttctaaatgaaatcaaatacatcgccagcgaccctgacgacaagcacttcttcaacgtcacagatgaggcggccctgaaggacattgttgatgcccttggggacaggatcttcagcttggaaggcaccaacaagaatgagacctcttttgggctggagatgtcgcagactggcttttcttcacatgtggtagaggatgggatcctgctgggagctgtgggagcctatgactggaacggggcggtgctgaaggagacaagtgctggcaaggtgattcctcaccgagagtcctaccttaaggagtttccagaggagctgaagaaccatgcagcatacctagggtacacggtgacgtcggttgtgtcctccaggcaggggcgggtgtatgtggctggagcccccagattcaaccatactggcaaggtcattctattcagcatgcacaacaaccggagcctcaccatccaccaggctcttcggggcgagcagataggctcctactttgggagtgagattacctcagtggacgtcaatgatgacagagtgacagatgtgctgctggtgggtgcacccatgtacttcagcgagggccgagagcgaggcaaggtgtatgtctacaacctgagacagaaccggtttgtttataatggcactctgaaggattcccacagctaccagaacgcccggttcgggtcctgcatcgcctctgttcaagacctcaaccaagattcctacaatgatgtggtggtgggggcccctctggaggacagccacagaggggccatctacatcttccatggcttccaaaccaatatcctgaagaagcccatgcagagaataacagcctcggagctggctcctggcctgcagcattttggctgcagcatccacggacaactggacctcaatgaggatgggcttgtggacctagcagtgggcgccctgggcaacgctgtggttttgtgggcccgccctgtagttcaaatcaacgccagcctccactttgagccttccaagatcaacatcttccacaaggactgcaagcgcaatggcagggatgccacctgcctggccgccttcctctgcttcatacccatcttcctggcaccccacttccaaacagcaaccgtcggcatcaggtacaatgcaaccatggatgagaggcggtatatgccgcgggcacatctggacgagggcggagaccagttcaccaacagagccgtcctgctctcctctggccaggaacactgtcaaaggatcaacttccatgtcctggacactgcagactacgtgaagccagtggccttctccgtggagtactccctagaggaccctgacaacggccccatgctggacaacggctggcccactacgctcagagtgtcggtgcccttctggaatggctgtaatgaggatgaacactgtgtccctgaccttgtactggatgctcggagtgacctgcccactgccatggagtactgccagcgggtgctggggaggccggcgcaggactgctccagctacaccctgtccttcgacaccactgtcttcatcatagagagcacgcgccgccgggtggcagtggaggccacgctggagaacagaggagagaatgcttacagcgccgtcctcaacatctcccagtcagagaaccttcagtttgccagcctgatccagaaggatgactcagacaacagcatcgagtgtgtgaacgaggagaggcggcttcacaagaaagtctgcaacgtcagctaccccttcttcagagccaaggccaaggtggctttccgtctggatttcgagttcagcaagtctgtgtttctgcaccatcttcagatccatctgggtgccggcagtgacagtcacgagcaagacagcaccgcagacgataacacggccctcctgcgcttccacctcaaatatgaagcagacgtcctctttaccagaagcagcagcctgagccacttcgaggtcaaggcaaacagctcacttgagagctatgatggcatcggacctccgttcaactgtgttttcaaggtgcagaacctgggctttttccccatccacggggtgatgatgaagatcactgtgcccatcgccaccaggggtggcaaccgcctgctgatgttgagggacttcttcaccgaccagggcaacacatcctgtaacatctgggggaacagcacagagtacaggagtaccccaactgaggaagatctgagccatgccccacagaggaatcacagcaactccgacgtggtctccatcatctgcaacctgaggctggcccccagccaggagaccagcttctacctggtgggaaacctgtggctgacatctctgaaagcactcaagtacaggtctctgaagatcacagtcaacgccgccttgcagaggcagttccacagccccttcatcttccgagaggaagaccctagccgccaggtcacatttgagatctccaagcaagaagactggcaggtccccatctggatcatcgtgggcagcactctggggggcctcttgctgctggccctgctggtcctggcactgtggaagctcggtttttttaaaagtgccaagcgcaagagggaacctggcctaggccccatccccaaagagctcaag

SEQ ID NO: 165 - protein, 1188 aa, Mus Musculus
  SIGNAL (1)...(22)
MDFPRGLLVAWTLSLWPGFTDTFNMDTRNPRVIAGPSAAFFGYTVQQHDISGKKWLVVGAPMETNGHQKTGDVYKCPVTQGNCTKLNLGRVTLSNVSERKDNMRLGLSLATNPKDNSFLACSPLWSHECGSSYYTTGMCSRVNSNFRFSKTVAPALQRCQTYMDIVIVLDGSNSIYPWVEVQHFLINILKKFYIGPGQIQVGIVQYGEDAVHEFHLNDYRSVKDVVEAASHIEQRGGTETRTAFGIEFARSEAFQKGGRKGAKKVMIVITDGESHDSPDLEKVIRQSEKDNVTRYAVAVLGYYNRRGINPETFLNEIKYIASDPDDKHFFNVTDEAALKDIVDALGDRIFSLEGTNKNETSFGLEMSQTGFSSHVVEDGILLGAVGAYDWNGAVLKETSAGKVIPHRESYLKEFPEELKNHAAYLGYTVTSVVSSRQGRVYVAGAPRFNHTGKVILFSMHNNRSLTIHQALRGEQIGSYFGSEITSVDVNDDRVTDVLLVGAPMYFSEGRERGKVYVYNLRQNRFVYNGTLKDSHSYQNARFGSCIASVQDLNQDSYNDVVVGAPLEDSHRGAIYIFHGFQTNILKKPMQRITASELAPGLQHFGCSIHGQLDLNEDGLVDLAVGALGNAVVLWARPVVQINASLHFEPSKINIFHKDCKRNGRDATCLAAFLCFIPIFLAPHFQTATVGIRYNATMDERRYMPRAHLDEGGDQFTNRAVLLSSGQEHCQRINFHVLDTADYVKPVAFSVEYSLEDPDNGPMLDNGWPTTLRVSVPFWNGCNEDEHCVPDLVLDARSDLPTAMEYCQRVLGRPAQDCSSYTLSFDTTVFIIESTRRRVAVEATLENRGENAYSAVLNISQSENLQFASLIQKDDSDNSIECVNEERRLHKKVCNVSYPFFRAKAKVAFRLDFEFSKSVFLHHLQIHLGAGSDSHEQDSTADDNTALLRFHLKYEADVLFTRSSSLSHFEVKANSSLESYDGIGPPFNCVFKVQNLGFFPIHGVMMKITVPIATRGGNRLLMLRDFFTDQGNTSCNIWGNSTEYRSTPTEEDLSHAPQRNHSNSDVVSIICNLRLAPSQETSFYLVGNLWLTSLKALKYRSLKITVNAALQRQFHSPFIFREEDPSRQVTFEISKQEDWQVPIWIIVGSTLGGLLLLALLVLALWKLGFFKSAKRKREPGLGPIPKELK

SEQ ID NO: 166 - protein, 1166 aa, Mus Musculus
FNMDTRNPRVIAGPSAAFFGYTVQQHDISGKKWLVVGAPMETNGHQKTGDVYKCPVTQGNCTKLNLGRVTLSNVSERKDNMRLGLSLATNPKDNSFLACSPLWSHECGSSYYTTGMCSRVNSNFRFSKTVAPALQRCQTYMDIVIVLDGSNSIYPWVEVQHFLINILKKFYIGPGQIQVGIVQYGEDAVHEFHLNDYRSVKDVVEAASHIEQRGGTETRTAFGIEFARSEAFQKGGRKGAKKVMIVITDGESHDSPDLEKVIRQSEKDNVTRYAVAVLGYYNRRGINPETFLNEIKYIASDPDDKHFFNVTDEAALKDIVDALGDRIFSLEGTNKNETSFGLEMSQTGFSSHVVEDGILLGAVGAYDWNGAVLKETSAGKVIPHRESYLKEFPEELKNHAAYLGYTVTSVVSSRQGRVYVAGAPRFNHTGKVILFSMHNNRSLTIHQALRGEQIGSYFGSEITSVDVNDDRVTDVLLVGAPMYFSEGRERGKVYVYNLRQNRFVYNGTLKDSHSYQNARFGSCIASVQDLNQDSYNDVVVGAPLEDSHRGAIYIFHGFQTNILKKPMQRITASELAPGLQHFGCSIHGQLDLNEDGLVDLAVGALGNAVVLWARPVVQINASLHFEPSKINIFHKDCKRNGRDATCLAAFLCFIPIFLAPHFQTATVGIRYNATMDERRYMPRAHLDEGGDQFTNRAVLLSSGQEHCQRINFHVLDTADYVKPVAFSVEYSLEDPDNGPMLDNGWPTTLRVSVPFWNGCNEDEHCVPDLVLDARSDLPTAMEYCQRVLGRPAQDCSSYTLSFDTTVFIIESTRRRVAVEATLENRGENAYSAVLNISQSENLQFASLIQKDDSDNSIECVNEERRLHKKVCNVSYPFFRAKAKVAFRLDFEFSKSVFLHHLQIHLGAGSDSHEQDSTADDNTALLRFHLKYEADVLFTRSSSLSHFEVKANSSLESYDGIGPPFNCVFKVQNLGFFPIHGVMMKITVPIATRGGNRLLMLRDFFTDQGNTSCNIWGNSTEYRSTPTEEDLSHAPQRNHSNSDVVSIICNLRLAPSQETSFYLVGNLWLTSLKALKYRSLKITVNAALQRQFHSPFIFREEDPSRQVTFEISKQEDWQVPIWIIVGSTLGGLLLLALLVLALWKLGFFKSAKRKREPGLGPIPKELK

SEQ ID NO: 167 - protein, 22 aa, Mus Musculus
  SIGNAL (1)...(22)
MDFPRGLLVAWTLSLWPGFTDT

SEQ ID NO: 168 - protein, 1141 aa, Mus Musculus
MDFPRGLLVAWTLSLWPGFTDTFNMDTRNPRVIAGPSAAFFGYTVQQHDISGKKWLVVGAPMETNGHQKTGDVYKCPVTQGNCTKLNLGRVTLSNVSERKDNMRLGLSLATNPKDNSFLACSPLWSHECGSSYYTTGMCSRVNSNFRFSKTVAPALQRCQTYMDIVIVLDGSNSIYPWVEVQHFLINILKKFYIGPGQIQVGIVQYGEDAVHEFHLNDYRSVKDVVEAASHIEQRGGTETRTAFGIEFARSEAFQKGGRKGAKKVMIVITDGESHDSPDLEKVIRQSEKDNVTRYAVAVLGYYNRRGINPETFLNEIKYIASDPDDKHFFNVTDEAALKDIVDALGDRIFSLEGTNKNETSFGLEMSQTGFSSHVVEDGILLGAVGAYDWNGAVLKETSAGKVIPHRESYLKEFPEELKNHAAYLGYTVTSVVSSRQGRVYVAGAPRFNHTGKVILFSMHNNRSLTIHQALRGEQIGSYFGSEITSVDVNDDRVTDVLLVGAPMYFSEGRERGKVYVYNLRQNRFVYNGTLKDSHSYQNARFGSCIASVQDLNQDSYNDVVVGAPLEDSHRGAIYIFHGFQTNILKKPMQRITASELAPGLQHFGCSIHGQLDLNEDGLVDLAVGALGNAVVLWARPVVQINASLHFEPSKINIFHKDCKRNGRDATCLAAFLCFIPIFLAPHFQTATVGIRYNATMDERRYMPRAHLDEGGDQFTNRAVLLSSGQEHCQRINFHVLDTADYVKPVAFSVEYSLEDPDNGPMLDNGWPTTLRVSVPFWNGCNEDEHCVPDLVLDARSDLPTAMEYCQRVLGRPAQDCSSYTLSFDTTVFIIESTRRRVAVEATLENRGENAYSAVLNISQSENLQFASLIQKDDSDNSIECVNEERRLHKKVCNVSYPFFRAKAKVAFRLDFEFSKSVFLHHLQIHLGAGSDSHEQDSTADDNTALLRFHLKYEADVLFTRSSSLSHFEVKANSSLESYDGIGPPFNCVFKVQNLGFFPIHGVMMKITVPIATRGGNRLLMLRDFFTDQGNTSCNIWGNSTEYRSTPTEEDLSHAPQRNHSNSDVVSIICNLRLAPSQETSFYLVGNLWLTSLKALKYRSLKITVNAALQRQFHSPFIFREEDPSRQVTFEISKQEDWQVP

SEQ ID NO: 169 - protein, 182 aa, Mus Musculus
DIVIVLDGSNSIYPWVEVQHFLINILKKFYIGPGQIQVGIVQYGEDAVHEFHLNDYRSVKDVVEAASHIEQRGGTETRTAFGIEFARSEAFQKGGRKGAKKVMIVITDGESHDSPDLEKVIRQSEKDNVTRYAVAVLGYYNRRGINPETFLNEIKYIASDPDDKHFFNVTDEAALKDIVDAL

SEQ ID NO: 170 - protein, 36 aa, Mus Musculus
AFFGYTVQQHDISGKKWLVVGAPMETNGHQKTGDVY

SEQ ID NO: 171 - protein, 43 aa, Mus Musculus; identical to SEQ ID NO: 153

SEQ ID NO: 172 - protein, 26 aa, Mus Musculus
SQTGFSSHVVEDGILLGAVGAYDWNG

SEQ ID NO: 173 - protein, 35 aa, Mus Musculus
HAAYLGYTVTSVVSSRQGRVYVAGAPRFNHTGKVI

SEQ ID NO: 174 - protein, 39 aa, Mus Musculus
SYFGSEITSVDVNDDRVTDVLLVGAPMYFSEGRERGKVY

SEQ ID NO: 175 - protein, 36 aa, Mus Musculus
ARFGSCIASVQDLNQDSYNDVVVGAPLEDSHRGAIY

SEQ ID NO: 176 - protein, 39 aa, Mus Musculus
QHFGCSIHGQLDLNEDGLVDLAVGALGNAVVLWARPVVQ

SEQ ID NO: 177 - protein, 23 aa, Mus Musculus
IWIIVGSTLGGLLLLALLVLALW

SEQ ID NO: 178 - protein, 24 aa, Mus Musculus
KLGFFKSAKRKREPGLGPIPKELK

SEQ ID NO: 179 - protein, 56 aa, Homo Sapiens
PGSYFGYSVAGVGDLNGDKSGYPDLLLVGAPRGAVYVYFGSSNSGGGRCIPLQNLS

SEQ ID NO: 180 - protein, 54 aa, Homo Sapiens
RTAFFGYTVQQHDISGNKWLVVGAPLETNGYQKTGDVYKCPVIHGNCTKLNLGR

SEQ ID NO: 181 - protein, 51 aa, Homo Sapiens
HGAYLGYTVTSVSSRQGRVYVAGAPRFNHTGKVILFTMHNNRSLTIHQAMR

SEQ ID NO: 182 - protein, 57 aa, Homo Sapiens
IGSYFGSEITSVDIDGDGVTDVLLVGAPMYFNEGRERGKVYVYELRQNRFVYNGTLK

SEQ ID NO: 183 - protein, 56 aa, Homo Sapiens
QNARFGSSIASVRDLNQDSYNDVVVGAPLEDNHAGAIYIFHGFRGSILKTPKQRIT

SEQ ID NO: 184 - protein, 55 aa, Artificial Sequence
  Markov Model Sequence
GLQYFGCSIHGQLDLNEDGLIDLAVGALGNAVILWSRPVVQINASLHFEPSKINI

SEQ ID NO: 185 - protein, 9 aa, Artificial Sequence
  CXC Signature Motif
  VARIANT (1)...(1): Xaa = 0-2 amino acids where each amino acid can be any amino acid
  VARIANT (3)...(3): Xaa = any amino acid
  VARIANT (5)...(5): Xaa = 20-24 amino acids where each amino acid can be any amino acid
  VARIANT (7)...(7): Xaa = 17-24 amino acids where each amino acid can be any amino acid
  VARIANT (9)...(9): Xaa = 0-2 amino acids where each amino acid can be any amino acid
XCXCXCXCX

SEQ ID NO: 186 - protein, 10 aa, Artificial Sequence
  CXC Signature Motif
  VARIANT (1)...(1): Xaa = 0-2 amino acids where each amino acid can be any amino acid
  VARIANT (3)...(3): Xaa = any amino acid
  VARIANT (5)...(5): Xaa = 23-24 amino acids where each amino acid can be any amino acid
  VARIANT (7)...(7): Xaa = 20-21 amino acids where each amino acid can be any amino acid
  VARIANT (9)...(10): Xaa = any amino acid
XCXCXCXCXX

SEQ ID NO: 187 - protein, 33 aa, Artificial Sequence
  CXC Signature Motif
  VARIANT (1)...(1): Xaa = 0-2 amino acids where each amino acid can be any amino acid
  VARIANT (3)...(3): Xaa = any amino acid
  VARIANT (5)...(5): Xaa = 6-7 amino acids where each amino acid can be any amino acid
  VARIANT (6)...(6): Xaa = L, I, V, M, F or Y
  VARIANT (7)...(8): Xaa = any amino acid
  VARIANT (9)...(9): Xaa = R, K, S, E or Q
  VARIANT (10)...(10): Xaa = any amino acid
  VARIANT (11)...(11): Xaa = L, I, V or M
  VARIANT (12)...(13): Xaa = any amino acid
  VARIANT (14)...(14): Xaa = L, I, V or M
  VARIANT (15)...(22): Xaa = any amino acid
  VARIANT (24)...(27): Xaa = any amino acid
  VARIANT (28)...(29): Xaa = L, I, V or M
  VARIANT (30)...(30): Xaa = 13-14 amino acids where each amino acid can be any amino acid
  VARIANT (32)...(32): Xaa = L, I, V or M
  VARIANT (33)...(33): Xaa = any amino acid
XCXCXXXXXXXXXXXXXXXXXXCXXXXXXXCXX

SEQ ID NO: 188 - protein, 37 aa, Artificial Sequence
  CXC Signature Motif
  VARIANT (1)...(1): Xaa = 0-1 amino acids where each amino acid can be any amino acid
  VARIANT (2)...(2): Xaa = R or K
  VARIANT (4)...(4): Xaa = R or K
  VARIANT (6)...(9): Xaa = any amino acid
  VARIANT (11)...(11): Xaa = 4-5 amino acids where each amino acid can be any amino acid
  VARIANT (12)...(12): Xaa = E or D
  VARIANT (13)...(18): Xaa = any amino acid
  VARIANT (19)...(19): Xaa = K or R
  VARIANT (20)...(24): Xaa = any amino acid
  VARIANT (26)...(27): Xaa = D or E
  VARIANT (28)...(28): Xaa = any amino acid
  VARIANT (29)...(32): Xaa = L, I, V, M, F or Y
  VARIANT (33)...(33): Xaa = 12-13 amino acids where each amino acid can be any amino acid
  VARIANT (36)...(36): Xaa = L, I, V or M
XXCXCXXXXPXXXXXXXXXXXXXXCXXXXXXXXHCXH

SEQ ID NO: 189 - protein, 6 aa, Artificial Sequence
  Repeat Consensus Sequence
  VARIANT (3)...(3): Xaa = 10-30 amino acids where each amino acid can be any amino acid
  VARIANT (4)...(4): Xaa = G or A
  VARIANT (6)...(6): Xaa = P, L or Q
FGXXAX

SEQ ID NO: 190 - protein, 6 aa, Artificial Sequence
  Repeat Consensus Sequence
  VARIANT (1)...(1): Xaa = G or S
  VARIANT (2)...(2): Xaa = F or Y
  VARIANT (3)...(3): Xaa = 10-35 amino acids where each amino acid can be any amino acid
  VARIANT (4)...(4): Xaa = G, V or L
  VARIANT (5)...(5): Xaa = A or M
  VARIANT (6)...(6): Xaa = P or Y
XXXXXX

SEQ ID NO: 191 - protein, 10 aa, Artificial Sequence
  I Domain Consensus Sequence
  VARIANT (4)...(4): Xaa = any amino acid
  VARIANT (6)...(6): Xaa = 5-15 amino acids where each amino acid can be any amino acid
  VARIANT (8)...(8): Xaa = 15-30 amino acids where each amino acid can be any amino acid
  VARIANT (1)...(10): Xaa = Any Amino Acid
DGSXSXFXQY

SEQ ID NO: 192 - protein, 8 aa, Artificial Sequence
  A259 Cytoplasmic Domain Consensus Sequence
  VARIANT (1)...(1): Xaa = F, Y, W or S
  VARIANT (2)...(2): Xaa = R or K
  VARIANT (3)...(3): Xaa = 0-1 amino acids where each amino acid can be any amino acid
  VARIANT (7)...(7): Xaa = 0-1 amino acids where each amino acid can be any amino acid
XXXGFFXR

SEQ ID NO: 193 - DNA, 21 bp, Artificial Sequence
  Oligonucleotide
tgcaacttttacaggaaacac

SEQ ID NO: 194 - DNA, 21 bp, Artificial Sequence
  Oligonucleotide
cctcacttttacccgagactc

SEQ ID NO: 195 - DNA, 21 bp, Artificial Sequence
  Oligonucleotide
gacgggtggtacttaaaacaa

What is claimed:

1. An isolated polypeptide selected from the group consisting of:
   a) a polypeptide comprising the amino acid sequence of SEQ ID NO:2;
   b) a polypeptide comprising the amino acid sequence from amino acid 18 to amino acid 685 of SEQ ID NO:2;
   c) a polypeptide comprising the amino acid sequence from amino acid 21 to amino acid 685 of SEQ ID NO:2;
   d) a polypeptide comprising the amino acid sequence encoded by the nucleic acid molecule of SEQ ID NO:1;
   e) a polypeptide comprising the amino acid sequence encoded by the nucleic acid molecule of SEQ ID NO:3;
   f) a polypeptide comprising the amino acid sequence encoded by the cDNA insert of the plasmid deposited with ATCC as Accession Number 98348; and
   g) a polypeptide comprising the amino acid sequence of the mature polypeptide encoded by the cDNA insert of the plasmid deposited with ATCC as Accession Number 98348.

2. The isolated polypeptide of claim 1, wherein the polypeptide comprises the amino acid sequence of SEQ ID NO:2.

3. The isolated polypeptide of claim 1, wherein the polypeptide comprises the amino acid sequence from amino acid 18 to amino acid 685 of SEQ ID NO:2.

4. The isolated polypeptide of claim 1, wherein the polypeptide comprises the amino acid sequence encoded by the nucleic acid molecule of SEQ ID NO:1.

5. The isolated polypeptide of claim 1, wherein the polypeptide comprises the amino acid sequence encoded by the nucleic acid molecule of SEQ ID NO:3.

6. The isolated polypeptide of claim 1, further comprising a heterologous amino acid sequence.

7. An isolated polypeptide comprising the amino acid sequence encoded by the cDNA insert of the plasmid deposited with ATCC as Accession Number 98348.

8. An The-isolated polypeptide comprising the amino acid sequence of the mature polypeptide encoded by the cDNA insert of the plasmid deposited with ATCC as Accession Number 98348.

9. A recombinant protein encoded by the cDNA insert of SEQ ID NO:1, SEQ ID NO:3 or the cDNA insert of the plasmid deposited with ATCC as Accession Number 98348.

10. The recombinant protein of claim 9 encoded by the cDNA insert of the plasmid deposited with ATCC as Accession Number 98348.

11. The recombinant protein of claim 9 encoded by SEQ ID NO: 3.

* * * * *